US010041073B2

(12) United States Patent
Khvorova et al.

(10) Patent No.: US 10,041,073 B2
(45) Date of Patent: *Aug. 7, 2018

(54) REDUCED SIZE SELF-DELIVERING RNAI COMPOUNDS

(75) Inventors: Anastasia Khvorova, Westborough, MA (US); William Salomon, Worcester, MA (US); Joanne Kamens, Newton, MA (US); Dmitry Samarsky, Westborough, MA (US); Tod M. Woolf, Sudbury, MA (US); James Cardia, Franklin, MA (US)

(73) Assignee: RXi Pharmaceuticals Corporation, Marlborough, MA (US)

( * ) Notice: Subject to any disclaimer, the term of this patent is extended or adjusted under 35 U.S.C. 154(b) by 533 days.

This patent is subject to a terminal disclaimer.

(21) Appl. No.: 13/069,780

(22) Filed: Mar. 23, 2011

(65) Prior Publication Data

US 2011/0263680 A1 Oct. 27, 2011

Related U.S. Application Data

(63) Continuation-in-part of application No. 13/120,342, filed as application No. PCT/US2009/005247 on Sep. 22, 2009, now Pat. No. 8,796,443.

(60) Provisional application No. 61/192,954, filed on Sep. 22, 2008, provisional application No. 61/149,946, filed on Feb. 4, 2009, provisional application No. 61/224,031, filed on Jul. 8, 2009.

(51) Int. Cl.
C12N 15/113 (2010.01)
C12N 15/11 (2006.01)

(52) U.S. Cl.
CPC ........ *C12N 15/1136* (2013.01); *C12N 15/111* (2013.01); *C12N 15/113* (2013.01); *C12N 15/1137* (2013.01); *C12N 2310/14* (2013.01); *C12N 2310/315* (2013.01); *C12N 2310/321* (2013.01); *C12N 2310/322* (2013.01); *C12N 2310/3231* (2013.01); *C12N 2310/3341* (2013.01); *C12N 2310/3515* (2013.01); *C12N 2310/3519* (2013.01); *C12N 2320/32* (2013.01); *C12N 2320/51* (2013.01)

(58) Field of Classification Search
CPC ................ C12N 15/111; C12N 15/113; C12N 2310/344
See application file for complete search history.

(56) References Cited

U.S. PATENT DOCUMENTS

| | | | |
|---|---|---|---|
| 3,687,808 A | 8/1972 | Merigan et al. |
| 4,201,860 A | 5/1980 | Naito et al. |
| 4,235,871 A | 11/1980 | Papahadjopoulos et al. |
| 4,415,732 A | 11/1983 | Caruthers et al. |
| 4,426,330 A | 1/1984 | Sears |
| 4,501,728 A | 2/1985 | Geho et al. |
| 4,737,323 A | 4/1988 | Martin et al. |
| 4,837,028 A | 6/1989 | Allen |
| 4,897,355 A | 1/1990 | Eppstein et al. |
| 4,904,582 A | 2/1990 | Tullis |
| 4,958,013 A | 9/1990 | Letsinger |
| 5,023,243 A | 6/1991 | Tullis |
| 5,112,963 A | 5/1992 | Pieles et al. |
| 5,149,782 A | 9/1992 | Chang et al. |
| 5,151,510 A | 9/1992 | Stec et al. |
| 5,177,198 A | 1/1993 | Spielvogel et al. |
| 5,185,444 A | 2/1993 | Summerton et al. |
| 5,188,897 A | 2/1993 | Suhadolnik et al. |
| 5,264,423 A | 11/1993 | Cohen et al. |
| 5,264,562 A | 11/1993 | Matteucci |
| 5,391,723 A | 2/1995 | Priest |
| 5,405,939 A | 4/1995 | Suhadolnik et al. |
| 5,414,077 A | 5/1995 | Lin et al. |
| 5,416,203 A | 5/1995 | Letsinger |
| 5,417,978 A | 5/1995 | Tari et al. |
| 5,432,272 A | 7/1995 | Benner |
| 5,453,496 A | 9/1995 | Caruthers et al. |
| 5,459,255 A | 10/1995 | Cook et al. |
| 5,466,786 A | 11/1995 | Buhr et al. |
| 5,470,967 A | 11/1995 | Huie et al. |
| 5,486,603 A | 1/1996 | Buhr |
| 5,489,677 A | 2/1996 | Sanghvi et al. |
| 5,495,009 A | 2/1996 | Matteucci et al. |
| 5,512,667 A | 4/1996 | Reed et al. |
| 5,514,786 A | 5/1996 | Cook et al. |
| 5,525,465 A | 6/1996 | Haralambidis et al. |
| 5,532,130 A | 7/1996 | Alul |

(Continued)

FOREIGN PATENT DOCUMENTS

| AU | 2004206255 B2 | 8/2004 |
|---|---|---|
| CN | 1 568 373 A | 1/2005 |

(Continued)

OTHER PUBLICATIONS

Liu et al. (Int. J. Mol. Sci. 2008, vol. 9, pp. 978-999).*
Ford (Leukemia Research (2006), vol. 30(5), pp. 511-513).*
Fabbri et al. (Proceed. Nat. Acad. Sci. (epub Sep. 21, 2007), vol. 104(40), pp. 15805-15810).*

(Continued)

*Primary Examiner* — J. E. Angell

(74) *Attorney, Agent, or Firm* — Wolf, Greenfield & Sacks, P.C.

(57) ABSTRACT

The present invention relates to RNAi constructs with minimal double-stranded regions, and their use in gene silencing. RNAi constructs associated with the invention include a double stranded region of 8-14 nucleotides and a variety of chemical modifications, and are highly effective in gene silencing. The RNAi constructs may be, for instance, miRNA constructs that are miRNA modulators.

24 Claims, 92 Drawing Sheets

(56) References Cited

U.S. PATENT DOCUMENTS

| | | | |
|---|---|---|---|
| 5,534,259 | A | 7/1996 | Zalipsky et al. |
| 5,556,948 | A | 9/1996 | Tagawa et al. |
| 5,561,225 | A | 10/1996 | Maddry et al. |
| 5,574,142 | A | 11/1996 | Meyer, Jr. et al. |
| 5,578,718 | A | 11/1996 | Cook et al. |
| 5,580,731 | A | 12/1996 | Chang et al. |
| 5,580,972 | A | 12/1996 | Tu et al. |
| 5,587,469 | A | 12/1996 | Cook et al. |
| 5,591,721 | A | 1/1997 | Agrawal et al. |
| 5,591,722 | A | 1/1997 | Montgomery et al. |
| 5,591,843 | A | 1/1997 | Eaton |
| 5,594,121 | A | 1/1997 | Froehler et al. |
| 5,596,086 | A | 1/1997 | Matteucci et al. |
| 5,596,091 | A | 1/1997 | Switzer |
| 5,599,797 | A | 2/1997 | Cook et al. |
| 5,602,240 | A | 2/1997 | De Mesmaeker et al. |
| 5,607,923 | A | 3/1997 | Cook et al. |
| 5,614,617 | A | 3/1997 | Cook et al. |
| 5,614,621 | A | 3/1997 | Ravikumar et al. |
| 5,623,070 | A | 4/1997 | Cook et al. |
| 5,625,050 | A | 4/1997 | Beaton et al. |
| 5,633,360 | A | 5/1997 | Bischofberger et al. |
| 5,643,889 | A | 7/1997 | Suhadolnik et al. |
| 5,646,126 | A | 7/1997 | Cheng et al. |
| 5,646,265 | A | 7/1997 | McGee |
| 5,658,731 | A | 8/1997 | Sproat et al. |
| 5,661,134 | A | 8/1997 | Cook et al. |
| 5,663,312 | A | 9/1997 | Chaturvedula |
| 5,670,633 | A | 9/1997 | Cook et al. |
| 5,674,683 | A | 10/1997 | Kool |
| 5,681,940 | A | 10/1997 | Wang et al. |
| 5,681,941 | A | 10/1997 | Cook et al. |
| 5,684,143 | A | 11/1997 | Gryaznov et al. |
| 5,688,941 | A | 11/1997 | Cook et al. |
| 5,700,785 | A | 12/1997 | Suhadolnik et al. |
| 5,700,920 | A | 12/1997 | Altmann et al. |
| 5,466,786 | B1 | 4/1998 | Buhr et al. |
| 5,736,392 | A | 4/1998 | Hawley-Nelson et al. |
| 5,750,666 | A | 5/1998 | Caruthers et al. |
| 5,767,099 | A | 6/1998 | Harris et al. |
| 5,770,713 | A | 6/1998 | Imbach et al. |
| 5,777,153 | A | 7/1998 | Lin et al. |
| 5,780,053 | A | 7/1998 | Ashley et al. |
| 5,789,416 | A | 8/1998 | Lum et al. |
| 5,792,847 | A | 8/1998 | Buhr et al. |
| 5,808,023 | A | 9/1998 | Sanghvi et al. |
| 5,817,781 | A | 10/1998 | Swaminathan et al. |
| 5,830,430 | A | 11/1998 | Unger et al. |
| 5,830,653 | A | 11/1998 | Froehler et al. |
| 5,851,548 | A | 12/1998 | Dattagupta et al. |
| 5,855,910 | A | 1/1999 | Ashley et al. |
| 5,856,455 | A | 1/1999 | Cook |
| 5,914,396 | A | 6/1999 | Cook et al. |
| 5,945,521 | A | 8/1999 | Just et al. |
| 5,948,767 | A | 9/1999 | Scheule et al. |
| 5,969,116 | A | 10/1999 | Martin |
| 5,976,567 | A | 11/1999 | Wheeler et al. |
| 5,981,501 | A | 11/1999 | Wheeler et al. |
| 5,986,083 | A | 11/1999 | Dwyer et al. |
| 6,001,841 | A | 12/1999 | Cook et al. |
| 6,005,096 | A | 12/1999 | Matteucci et al. |
| 6,015,886 | A | 1/2000 | Dale et al. |
| 6,020,475 | A | 2/2000 | Capaldi et al. |
| 6,020,483 | A | 2/2000 | Beckvermit et al. |
| 6,028,183 | A | 2/2000 | Lin et al. |
| 6,033,910 | A | 3/2000 | Monia et al. |
| 6,043,352 | A | 3/2000 | Manoharan et al. |
| 6,051,699 | A | 4/2000 | Ravikumar |
| 6,096,875 | A | 8/2000 | Khan et al. |
| 6,107,094 | A | 8/2000 | Crooke |
| 6,111,085 | A | 8/2000 | Cook et al. |
| 6,121,437 | A | 9/2000 | Guzaev et al. |
| 6,153,737 | A | 11/2000 | Manoharan et al. |
| 6,172,208 | B1 | 1/2001 | Cook |
| 6,207,819 | B1 | 3/2001 | Manoharan et al. |
| 6,271,358 | B1 | 8/2001 | Manoharan et al. |
| 6,326,358 | B1 | 12/2001 | Manoharan |
| 6,331,617 | B1 | 12/2001 | Weeks et al. |
| 6,335,434 | B1 | 1/2002 | Guzaev et al. |
| 6,335,437 | B1 | 1/2002 | Manoharan |
| 6,344,436 | B1 | 2/2002 | Smith et al. |
| 6,355,787 | B1 | 3/2002 | Beckvermit et al. |
| 6,358,931 | B1 | 3/2002 | Cook et al. |
| 6,395,474 | B1 | 5/2002 | Buchardt et al. |
| 6,395,492 | B1 | 5/2002 | Manoharan et al. |
| 6,399,754 | B1 | 6/2002 | Cook |
| 6,410,702 | B1 | 6/2002 | Swaminathan et al. |
| 6,420,549 | B1 | 7/2002 | Cook et al. |
| 6,432,963 | B1 | 8/2002 | Hisamichi et al. |
| 6,440,943 | B1 | 8/2002 | Cook et al. |
| 6,444,806 | B1 | 9/2002 | Veerapanani et al. |
| 6,465,628 | B1 | 10/2002 | Ravikumar et al. |
| 6,476,205 | B1 | 11/2002 | Buhr et al. |
| 6,506,559 | B1 | 1/2003 | Fire et al. |
| 6,528,631 | B1 | 3/2003 | Cook et al. |
| 6,531,584 | B1 | 3/2003 | Cook et al. |
| 6,559,279 | B1 | 5/2003 | Manoharan et al. |
| 6,656,730 | B1 | 12/2003 | Manoharan |
| 6,673,611 | B2 | 1/2004 | Thompson et al. |
| 6,683,167 | B2 | 1/2004 | Metelev et al. |
| 6,815,432 | B2 | 11/2004 | Wheeler et al. |
| 6,849,726 | B2 | 2/2005 | Usman et al. |
| 6,858,225 | B2 | 2/2005 | Semple et al. |
| 7,041,824 | B2 | 5/2006 | Bordon-Pallier et al. |
| 7,056,704 | B2 | 6/2006 | Tuschl et al. |
| 7,078,196 | B2 | 7/2006 | Tuschl et al. |
| 7,132,530 | B2 | 11/2006 | Bennett et al. |
| 7,205,297 | B2 | 4/2007 | Beauchamp et al. |
| 7,432,250 | B2 | 10/2008 | Crooke |
| 7,538,095 | B2 | 5/2009 | Fire et al. |
| 7,560,438 | B2 | 7/2009 | Fire et al. |
| 7,595,387 | B2 | 9/2009 | Leake et al. |
| 7,622,455 | B2 | 11/2009 | Bennett et al. |
| 7,622,633 | B2 | 11/2009 | Fire et al. |
| 7,629,321 | B2 | 12/2009 | Crooke |
| 7,695,902 | B2 | 4/2010 | Crooke |
| 7,745,608 | B2 | 6/2010 | Manoharan et al. |
| 7,750,144 | B2 | 7/2010 | Zamore et al. |
| 7,786,290 | B2 | 8/2010 | Woppmann et al. |
| 7,829,693 | B2 | 11/2010 | Kreutzer et al. |
| 7,902,163 | B2 | 3/2011 | Bennett et al. |
| 8,110,674 | B2 | 2/2012 | Manoharan et al. |
| 8,263,569 | B2 | 9/2012 | Baulcombe et al. |
| 8,383,600 | B2 | 2/2013 | Czech et al. |
| 8,664,189 | B2 | 3/2014 | Khvorova et al. |
| 8,796,443 | B2 * | 8/2014 | Khvorova ............ C12N 15/111 536/23.1 |
| 8,815,818 | B2 | 8/2014 | Samarsky et al. |
| 9,074,211 | B2 | 7/2015 | Woolf et al. |
| 9,080,171 | B2 * | 7/2015 | Khvorova ............ C07H 21/02 |
| 9,095,504 | B2 | 8/2015 | Libertine et al. |
| 9,175,289 | B2 * | 11/2015 | Khvorova ............ C12N 15/111 |
| 9,222,092 | B2 | 12/2015 | Giese et al. |
| 9,303,259 | B2 | 4/2016 | Khvorova et al. |
| 9,340,786 | B2 | 5/2016 | Khvorova et al. |
| 9,493,774 | B2 | 11/2016 | Kamens |
| 9,745,574 | B2 | 8/2017 | Woolf et al. |
| 2002/0132788 | A1 | 9/2002 | Lewis et al. |
| 2002/0147332 | A1 | 10/2002 | Kaneko et al. |
| 2002/0160393 | A1 | 10/2002 | Symonds et al. |
| 2002/0162126 | A1 | 10/2002 | Beach et al. |
| 2003/0004325 | A1 | 1/2003 | Cook et al. |
| 2003/0077829 | A1 | 4/2003 | MacLachlan |
| 2003/0108923 | A1 | 6/2003 | Tuschl et al. |
| 2003/0139585 | A1 | 7/2003 | Uhlmann et al. |
| 2003/0157030 | A1 | 8/2003 | Davis et al. |
| 2003/0158403 | A1 | 8/2003 | Manoharan et al. |
| 2003/0166282 | A1 | 9/2003 | Brown et al. |
| 2004/0009938 | A1 | 1/2004 | Manoharan et al. |
| 2004/0014957 | A1 | 1/2004 | Eldrup et al. |
| 2004/0018999 | A1 | 1/2004 | Beach et al. |
| 2004/0054155 | A1 | 3/2004 | Woolf et al. |
| 2004/0063654 | A1 | 4/2004 | Davis et al. |
| 2004/0072785 | A1 | 4/2004 | Wolff et al. |

(56) References Cited

U.S. PATENT DOCUMENTS

| | | |
|---|---|---|
| 2004/0137471 A1 | 7/2004 | Vickers et al. |
| 2004/0162235 A1 | 8/2004 | Trubetskoy et al. |
| 2004/0167090 A1 | 8/2004 | Monahan et al. |
| 2004/0171033 A1* | 9/2004 | Baker et al. |
| 2004/0180351 A1 | 9/2004 | Giese et al. |
| 2004/0191773 A1 | 9/2004 | Crooke |
| 2004/0192629 A1 | 9/2004 | Xu et al. |
| 2004/0204377 A1 | 10/2004 | Rana |
| 2004/0229266 A1 | 11/2004 | Tuschl et al. |
| 2004/0241845 A1 | 12/2004 | Desgroseillers et al. |
| 2004/0248839 A1 | 12/2004 | Kowalik |
| 2004/0259247 A1 | 12/2004 | Tuschl et al. |
| 2005/0020521 A1 | 1/2005 | Rana |
| 2005/0026286 A1 | 2/2005 | Chi et al. |
| 2005/0032733 A1 | 2/2005 | McSwiggen et al. |
| 2005/0037496 A1 | 2/2005 | Rozema et al. |
| 2005/0042227 A1 | 2/2005 | Zankel et al. |
| 2005/0064595 A1 | 3/2005 | MacLachlan et al. |
| 2005/0080246 A1 | 4/2005 | Allerson et al. |
| 2005/0107325 A1 | 5/2005 | Manoharan et al. |
| 2005/0142535 A1 | 6/2005 | Damha et al. |
| 2005/0181382 A1 | 8/2005 | Zamore et al. |
| 2005/0239731 A1 | 10/2005 | McSwiggen et al. |
| 2005/0245474 A1 | 11/2005 | Baker et al. |
| 2005/0246794 A1 | 11/2005 | Khvorova et al. |
| 2005/0255487 A1 | 11/2005 | Khvorova et al. |
| 2005/0281781 A1 | 12/2005 | Ostroff |
| 2006/0008910 A1 | 1/2006 | MacLachlan et al. |
| 2006/0009409 A1 | 1/2006 | Woolf |
| 2006/0069050 A1 | 3/2006 | Rana |
| 2006/0127891 A1 | 6/2006 | McSwiggen et al. |
| 2006/0142228 A1 | 6/2006 | Ford et al. |
| 2006/0178324 A1 | 8/2006 | Hadwiger et al. |
| 2006/0178327 A1 | 8/2006 | Yeung |
| 2006/0240093 A1 | 10/2006 | MacLachlan et al. |
| 2006/0247193 A1* | 11/2006 | Taira et al. ............. 514/44 |
| 2007/0032441 A1 | 2/2007 | McSwiggen et al. |
| 2007/0166734 A1 | 7/2007 | Bhat et al. |
| 2007/0167384 A1* | 7/2007 | Leake et al. ............ 514/44 |
| 2007/0173476 A1 | 7/2007 | Leake et al. |
| 2007/0231392 A1 | 10/2007 | Wagner et al. |
| 2007/0269889 A1* | 11/2007 | Leake et al. ........... 435/375 |
| 2008/0020990 A1 | 1/2008 | Yano et al. |
| 2008/0038296 A1 | 2/2008 | Brahmbhatt et al. |
| 2008/0071068 A1 | 3/2008 | Oba et al. |
| 2008/0085869 A1 | 4/2008 | Yamada et al. |
| 2008/0107694 A1 | 5/2008 | Trogden et al. |
| 2008/0112916 A1 | 5/2008 | Wagner et al. |
| 2008/0152661 A1 | 6/2008 | Rozema et al. |
| 2008/0311040 A1 | 12/2008 | Berry et al. |
| 2009/0023216 A1 | 1/2009 | Woolf |
| 2009/0131360 A1 | 5/2009 | Woolf et al. |
| 2009/0143326 A1* | 6/2009 | Obad ............ C12N 15/111 514/44 R |
| 2009/0186802 A1 | 7/2009 | Alluis et al. |
| 2009/0208564 A1 | 8/2009 | Li et al. |
| 2009/0247608 A1 | 10/2009 | Manoharan et al. |
| 2009/0298916 A1 | 12/2009 | Kauppinen et al. |
| 2010/0069620 A1 | 3/2010 | Zon |
| 2010/0081705 A1 | 4/2010 | Bennett et al. |
| 2010/0136695 A1 | 6/2010 | Woolf |
| 2010/0286234 A1 | 11/2010 | Elmen et al. |
| 2011/0039914 A1 | 2/2011 | Pavco et al. |
| 2011/0237522 A1 | 9/2011 | Khvorova et al. |
| 2011/0237648 A1 | 9/2011 | Khvorova et al. |
| 2011/0251258 A1 | 10/2011 | Samarsky et al. |
| 2011/0268761 A1 | 11/2011 | Levis et al. |
| 2011/0288147 A1 | 11/2011 | Brown et al. |
| 2012/0016005 A1 | 1/2012 | Samarsky et al. |
| 2012/0040459 A1 | 2/2012 | Khvorova et al. |
| 2012/0059046 A1 | 3/2012 | Woolf et al. |
| 2012/0065243 A1 | 3/2012 | Woolf et al. |
| 2012/0094374 A1 | 4/2012 | Bentwich et al. |
| 2013/0131141 A1 | 5/2013 | Khvorova et al. |
| 2013/0131142 A1 | 5/2013 | Libertine et al. |
| 2013/0197055 A1 | 8/2013 | Kamens et al. |
| 2014/0113950 A1 | 4/2014 | Khvorova et al. |
| 2015/0057362 A1 | 2/2015 | Levis et al. |
| 2016/0115482 A1 | 4/2016 | Libertine et al. |
| 2016/0115484 A1 | 4/2016 | Woolf et al. |
| 2016/0130578 A1 | 5/2016 | Khvorova et al. |
| 2016/0244765 A1 | 8/2016 | Khvorova et al. |
| 2016/0304873 A1 | 10/2016 | Wolfson et al. |
| 2016/0304875 A1 | 10/2016 | Cauwenbergh et al. |
| 2016/0319278 A1 | 11/2016 | Khvorova et al. |
| 2016/0355808 A1 | 12/2016 | Khvorova et al. |
| 2016/0355826 A1 | 12/2016 | Khvorova et al. |
| 2017/0009239 A1 | 1/2017 | Khvorova et al. |
| 2017/0051288 A1 | 2/2017 | Byrne et al. |
| 2017/0051290 A1 | 2/2017 | Byrne et al. |
| 2017/0067056 A1 | 3/2017 | Khvorova et al. |
| 2017/0137823 A1 | 5/2017 | Kamens et al. |
| 2018/0030451 A1 | 2/2018 | Cauwenbergh |

FOREIGN PATENT DOCUMENTS

| | | |
|---|---|---|
| EP | 0 552 766 A2 | 7/1993 |
| EP | 1 214 945 A2 | 6/2002 |
| EP | 1 144 623 B9 | 3/2003 |
| EP | 1 352 061 B1 | 10/2003 |
| EP | 0 928 290 B9 | 3/2005 |
| EP | 1 407 044 B1 | 9/2007 |
| EP | 1 605 978 B1 | 9/2010 |
| JP | 4 095 895 B2 | 9/2004 |
| JP | 2009-519033 | 5/2009 |
| WO | WO 90/14074 A1 | 11/1990 |
| WO | WO 91/16024 A1 | 10/1991 |
| WO | WO 91/17424 A1 | 11/1991 |
| WO | WO 92/03464 A1 | 3/1992 |
| WO | WO 94/23028 A2 | 10/1994 |
| WO | WO 95/11910 A1 | 5/1995 |
| WO | WO 95/23162 A1 | 8/1995 |
| WO | WO 96/40964 A2 | 12/1996 |
| WO | WO 99/13915 A1 | 3/1999 |
| WO | WO 03/012052 A2 | 2/2003 |
| WO | WO 2003/064626 A2 | 8/2003 |
| WO | WO 2004/042027 A2 | 5/2004 |
| WO | WO 2004/065600 A2 | 8/2004 |
| WO | WO 2004/065601 A2 | 8/2004 |
| WO | WO 2004/090105 A2 | 10/2004 |
| WO | WO 2005/019430 A2 | 3/2005 |
| WO | WO 2005/078096 A2 | 8/2005 |
| WO | WO 2005/079533 A2 | 9/2005 |
| WO | WO 2005/097992 A2 | 10/2005 |
| WO | WO 2006/007372 A2 | 1/2006 |
| WO | WO 2006/019430 A2 | 2/2006 |
| WO | WO 2006/039656 A2 | 4/2006 |
| WO | WO 2006/065601 A2 | 6/2006 |
| WO | WO 2006/113679 A2 | 10/2006 |
| WO | WO 2006/128141 A2 | 11/2006 |
| WO | WO 2007/030167 A1 | 3/2007 |
| WO | WO 2007/044362 A2 | 4/2007 |
| WO | WO 2007/050643 A2 | 5/2007 |
| WO | WO 2007/069068 A2 | 6/2007 |
| WO | WO 2007/089607 A2 | 8/2007 |
| WO | WO 2008/036825 A2 | 3/2008 |
| WO | WO 2008/109353 A1 | 9/2008 |
| WO | WO 2009/005813 A1 | 1/2009 |
| WO | WO 2009/020344 A2 | 2/2009 |
| WO | WO 2009/029688 A3 | 3/2009 |
| WO | WO 2009/029690 A1 | 3/2009 |
| WO | WO 2009/044392 A2 | 4/2009 |
| WO | WO 2009/078685 A2 | 6/2009 |
| WO | WO 2010/006237 A2 | 1/2010 |
| WO | WO 2010/027830 A2 | 3/2010 |
| WO | WO 2010/042281 A2 | 4/2010 |
| WO | WO 2011/109698 A1 | 9/2011 |

OTHER PUBLICATIONS

[No Author Listed] RedChip Small-Cap Investor Conference. RXI Pharmaceuticals (Nasdaq RXII). Jun. 16, 2009 Presentation. 5 pages.

(56) References Cited

OTHER PUBLICATIONS

Aleckovic et al., RNAi at Oxford. J RNAi Gene Silencing. May 27, 2008;4(1):266-8.
Aouadi et al., Orally delivered siRNA targeting macrophage Map4k4 suppresses systemic inflammation. Nature. Apr. 30, 2009;458(7242):1180-4. doi: 10.1038/nature07774.
Baigude et al., Design and creation of new nanomaterials for therapeutic RNAi. ACS Chem Biol. Apr. 24, 2007;2(4):237-41.
Bergan et al., Electroporation enhances c-myc antisense oligodeoxynucleotide efficacy. Nucleic Acids Res. Jul. 25, 1993;21(15):3567-73.
Bjergarde et al., Solid phase synthesis of oligodeoxyribonucleoside phosphorodithioates from thiophosphoramidites. Nucleic Acids Res. Nov. 11, 1991;19(21):5843-50.
Bongartz et al., Improved biological activity of antisense oligonucleotides conjugated to a fusogenic peptide. Nucleic Acids Res. Nov. 11, 1994;22(22):4681-8.
Boutorin et al., Synthesis of alkylating oligonucleotide derivatives containing cholesterol or phenazinium residues at their 3'-terminus and their interaction with DNA within mammalian cells. FEBS Lett. Aug. 28, 1989;254(1-2):129-32.
Braasch et al., RNA Interference in Mammalian Cells by Chemically-Modified RNA. Biochem. 2003;42(26):7967-75.
Brown et al., Light at the end of the tunnel. J RNAi Gene Silencing. Jul. 28, 2006;2(2):175-7.
Chiu et al., siRNA function in RNAi: a chemical modification analysis. RNA. Sep. 2003;9(9):1034-48.
Choung et al. Chemical modification of siRNAs to improve serum stability without loss of efficacy. Biochem Biophys Res Commun. Apr. 14, 2006;342(3):919-27.
Chu et al., Potent RNAi by short RNA triggers. RNA. 2008;14:1714-9.
Cload et al., Polyether tethered oligonucleotide probes. Journal of the American Chemical Society. 1991;113 (16): 6324-6326.
Collins et al., A small interfering RNA screen for modulators of tumor cell motility identifies MAP4K4 as a promigratory kinase. Proc Natl Acad Sci U S A. Mar. 7, 2006; 103(10): 3775-3780.
Constantinides et al., Formulation and intestinal absorption enhancement evaluation of water-in-oil microemulsions incorporating medium-chain glycerides. Pharm Res. Oct. 1994;11(10):1385-90.
Czauderna et al., Structural variations and stabilising modifications of synthetic siRNAs in mammalian cells. Nucleic Acids Res. Jun. 1, 2003;31(11):2705-16.
De Smidt et al., Association of antisense oligonucleotides with lipoproteins prolongs the plasma half-life and modifies the tissue distribution. Nucleic Acids Res. Sep. 11, 1991;19(17):4695-700.
Debart et al., Chemical modifications to improve the cellular uptake of oligonucleotides. Curr Top Med Chem. 2007;7(7):727-37.
Dykxhoorn et al., The silent treatment: siRNAs as small molecule drugs. Gene Ther. Mar. 2006;13(6):541-52. Review.
Elbashir et al., Duplexes of 21-nucleotide RNAs mediate RNA interference in cultured mammalian cells. Nature. May 24, 2001;411(6836):494-8.
Elbashir et al., Functional anatomy of siRNAs for mediating efficient RNAi in *Drosophila melanogaster* embryo lysate. EMBO J. Dec. 3, 2001;20(23):6877-88.
Fedorov et al., Off-target effects by siRNA can induce toxic phenotype. RNA. Jul. 2006;12(7):1188-96. Epub May 8, 2006.
Ferentz et al., Disulfide-crosslinked oligonucleotides. Journal of the American Chemical Society. 1991;113 (10): 4000-4002.
Griffiths-Jones et al., miRBase: microRNA sequences, targets and gene nomenclature. Nucleic Acids Res. Jan. 1, 2006;34(Database issue):D140-4.
Griffiths-Jones et al., miRBase: tools for microRNA genomics. Nucleic Acids Res. Jan. 2008;36(Database issue):D154-8. Epub Nov. 8, 2007.
Griffiths-Jones et al., The microRNA Registry. Nucleic Acids Res. Jan. 1, 2004;32(Database issue):D109-11.

Jablonski et al., Preparation of oligodeoxynucleotide-alkaline phosphatase conjugates and their use as hybridization probes. Nucleic Acids Res. Aug. 11, 1986;14(15):6115-28.
Jackson et al., Position-specific chemical modification of siRNAs reduces "off-target" transcript silencing. RNA. Jul. 2006;12(7):1197-1205. Epub May 8, 2006.
Jiang et al., miR2Disease: a manually curated database for microRNA deregulation in human disease. Nucleic Acids Res. Jan. 2009;37(Database issue):D98-104. doi:10.1093/nar/gkn714. Epub Oct. 15, 2008.
Kamata et al., Amphiphilic peptides enhance the efficiency of liposome-mediated DNA transfection. Nucleic Acids Res. Feb. 11, 1994;22(3):536-7.
Kim et al., Systemic and specific delivery of small interfering RNAs to the liver mediated by apolipoprotein A-I. Mol Ther. Jun. 2007;15(6):1145-52. Epub Apr. 17, 2007.
Kraynack et al., Small interfering RNAs containing full 2'-O-methylribonucleotide-modified sense strands display Argonaute2/eIF2C2-dependent activity. RNA. Jan. 2006;12(1):163-76. Epub Nov. 21, 2005.
Krutzfeldt et al., Silencing of microRNAs in vivo with 'antagomirs'. Nature. Dec. 1, 2005;438(7068):685-9. Epub Oct. 30, 2005.
Kubo et al., Modified 27-nt dsRNAs with dramatically enhanced stability in serum and long-term RNAi activity. Oligonucleotides. 2007 Winter;17(4):445-64.
Layzer et al., In vivo activity of nuclease-resistant siRNAs. RNA. May 2004;10(5):766-71.
Lee et al., Contributions of 3'-overhang to the dissociation of small interfering RNAs from the PAZ domain: molecular dynamics simulation study. J Mol Graph Model. Mar. 2007;25(6):784-93. Epub Jul. 11, 2006.
Letsinger et al., Cholesteryl-conjugated oligonucleotides: synthesis, properties, and activity as inhibitors of replication of human immunodeficiency virus in cell culture. Proc Natl Acad Sci U S A. Sep. 1989;86(17):6553-6.
Leuschner et al., Cleavage of the siRNA passenger strand during RISC assembly in human cells. EMBO Rep. Mar. 2006;7(3):314-20. Epub Jan. 20, 2006.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Li et al., Surface-modified LPD nanoparticles for tumor targeting. Ann N Y Acad Sci. Oct. 2006;1082:1-8.
Lu et al., An analysis of human microRNA and disease associations. PLoS One. 2008;3(10):e3420. doi:10.1371/journal.pone.0003420. Epub Oct. 15, 2008.
Ma et al., Design and synthesis of RNA miniduplexes via a synthetic linker approach. Biochemistry. Feb. 23, 1993;32(7):1751-8.
Ma et al., Design and synthesis of RNA miniduplexes via a synthetic linker approach. 2. Generation of covalently closed, double-stranded cyclic HIV-1 TAR RNA analogs with high Tat-binding affinity. Nucleic Acids Res. Jun. 11, 1993;21(11):2585-9.
Manoharan et al., Chemical modifications to improve uptake and bioavailability of antisense oligonucleotides. Ann N Y Acad Sci. Oct. 28, 1992;660:306-9.
Manoharan, Oligonucleotide conjugates as potential antisense drugs with improved uptake, biodistribution, targeted delivery, and mechanism of action. Antisense Nucleic Acid Drug Dev. Apr. 2002;12(2):103-28.
Martins et al., Sterol side chain length and structure affect the clearance of chylomicron-like lipid emulsions in rats and mice. J Lipid Res. Feb. 1998;39(2):302-12.
Mescalchin et al., Cellular uptake and intracellular release are major obstacles to the therapeutic application of siRNA: novel options by phosphorothioate-stimulated delivery. Expert Opin Biol Ther. Oct. 2007;7(10):1531-8. Review.
Mori et al., Molecular mechanisms linking wound inflammation and fibrosis: knockdown of osteopontin leads to rapid repair and reduced scarring. J Exp Med. Jan. 21, 2008;205(1):43-51. doi: 10.1084/jem.20071412. Epub Jan. 7, 2008. Online Supplemental Material Included. 4 Pages.

(56) References Cited

OTHER PUBLICATIONS

Murphy et al., A combinatorial approach to the discovery of efficient cationic peptoid reagents for gene delivery. Proc Natl Acad Sci U S A. Feb. 17, 1998;95(4):1517-22.
Oberhauser et al., Effective incorporation of 2'-O-methyl-oligoribonucleotides into liposomes and enhanced cell association through modification with thiocholesterol. Nucleic Acids Res. Feb. 11, 1992;20(3):533-8.
Ono et al., DNA triplex formation of oligonucleotide analogues consisting of linker groups and octamer segments that have opposite sugar-phosphate backbone polarities. Biochemistry. Oct. 15, 1991;30(41):9914-2.
Overhoff et al., Phosphorothioate-stimulated uptake of short interfering RNA by human cells. EMBO Rep. Dec. 2005;6(12):1176-81.
Rajeev et al., 2'-modified-2-thiothymidine oligonucleotides. Org Lett. Aug. 21, 2003;5(17):3005-8.
Rump et al., Preparation of conjugates of oligodeoxynucleotides and lipid structures and their interaction with low-density lipoprotein. Bioconjug Chem. May-Jun. 1998;9(3):341-9.
Sato et al., Tumor targeting and imaging of intraperitoneal tumors by use of antisense oligo-DNA complexed with dendrimers and/or avidin in mice. Clin Cancer Res. Nov. 2001;7(11):3606-12.
Shen, Advances in the development of siRNA-based therapeutics for cancer. IDrugs. Aug. 2008;11(8):572-8. Review.
Shi, Mammalian RNAi for the masses. Trends Genet. Jan. 2003;19(1):9-12.
Soutschek et al., Therapeutic silencing of an endogenous gene by systemic administration of modified siRNAs. Nature. Nov. 11, 2004;432(7014):173-8.
Sui et al., A DNA vector-based RNAi technology to suppress gene expression in mammalian cells. Proc Natl Acad Sci U S A. Apr. 16, 2002;99(8):5515-20.
Sun et al., Asymmetric RNA duplexes mediate RNA interference in mammalian cells. Nat Biotechnol. Dec. 2008;26(12):1379-82. doi: 10.1038/nbt.1512. Epub Nov. 23, 2008.
Tang et al., An RNA interference-based screen identifies MAP4K4/NIK as a negative regulator of PPARgamma, adipogenesis, and insulin-responsive hexose transport. Proc Natl Acad Sci U S A. Feb. 14, 2006;103(7):2087-92. Epub Feb. 3, 2006.
Tang et al., MicroRNAs are tightly associated with RNA-induced gene silencing complexes in vivo. Biochem Biophys Res Commun. Jul. 18, 2008;372(1):24-9. doi:10.1016/j.bbrc.2008.04.137. Epub May 12, 2008.
Uhlmann et al., Antisense oligonucleotides: a new therapeutic principle. Chem Rev. 1990;90(4):543-84.
Vlassov et al., Transport of oligonucleotides across natural and model membranes. Biochim Biophys Acta. Jun. 29, 1994;1197(2):95-108.
Wolfrum et al., Mechanisms and optimization of in vivo delivery of lipophilic siRNAs. Nat Biotechnol. Oct. 2007;25(10):1149-57. Epub Sep. 16, 2007.
Xue et al., Mesodermal patterning defect in mice lacking the Ste20 NCK interacting kinase (NIK). Development. May 2001;128(9):1559-72.
Yamada et al., Synthesis and properties of oligonucleotides having a chemically stable 2-(trimethylsilyl)benzoyl group. Nucleic Acids Symp Ser (Oxf). 2008;(52):301-2. doi: 10.1093/nass/nrn152.
Yu et al., RNA interference by expression of short-interfering RNAs and hairpin RNAs in mammalian cells. Proc Natl Acad Sci U S A. Apr. 30, 2002;99(9):6047-52. Epub Apr. 23, 2002.
[No Author Listed] RedChip Small-Cap Investor Conference. RXI Pharmaceuticals (Nasdaq RXII). Jun. 16, 2009 Presentation. 22 pages.
[No Author Listed], RXi Pharmaceuticals Presents Self-Delivering RNAi Data at Scar Club Meeting in France. Drugs.com. Mar. 26, 2010. http://www.drugs.com/clinical_trials/rxi-pharmaceuticals-presents-self-delivering-rnai-data-scar-club-meeting-france-9093.html [last accessed Aug. 19, 2014].
Cardia et al., Novel self-delivering RNAi compounds with enhanced cellular uptake and distribution properties. Keystone RNAi Silencing Conference. Jan. 14-19, 2010. Poster. 1 Page.
Kamens et al., Novel, chemically modified RNAi compounds with improved potency, stability and specificity. Keystone RNAi Silencing: Mechanism, Biology and Application Conference. Jan. 14-19, 2010. Poster. 1 Page.
Mathews et al., Incorporating chemical modification constraints into a dynamic programming algorithm for prediction of RNA secondary structure. Proc Natl Acad Sci U S A. May 11, 2004;101(19):7287-92. Epub May 3, 2004.
Parrish et al., Functional anatomy of a dsRNA trigger: differential requirement for the two trigger strands in RNA interference. Mol Cell. Nov. 2000;6(5):1077-87.
Pavco et al., Robust Intradermal efficacy with novel chemically modified self-delivering RNAi compounds. Keystone RNAi Silencing Conference: Mechanism, Biology and Application Conference. Jan. 14-19, 2010. Poster. 1 Page.
Salomon et al., Modified dsRNAs that are not processed by Dicer maintain potency and are incorporated into the RISC. Nucleic Acids Res. Jun. 2010;38(11):3771-9. doi: 10.1093/nar/gkq055. Epub Feb. 18, 2010.
Seela et al., Oligodeoxyribonucleotides containing 1,3-propanediol as nucleoside substitute. Nucleic Acids Res. Apr. 10, 1987;15(7):3113-29.
Holmes et al., Syntheses and oligonucleotide incorporation of nucleoside analogues containing pendant imidazolyl or amino functionalities—the search for sequence-specific artificial ribonucleases. Eur J Org Chem. Apr. 13, 2005;5171-83. DOI; 10.1002/ejoc.20050413.
Rozners et al., Expanding functionality of RNA: synthesis and properties of RNA containing imidazole modified tandem G-U wobble base pairs. Chem Commun (Camb). Dec. 14, 2005;(46):5778-80.
[No Author Listed] Rxi Pharmaceutical Corporation. Ex 99.1. OTC: RXII. Mar. 2013. 38 pages.
Augustyns et al., Incorporation of hexose nucleoside analogues into oligonucleotides: synthesis, base-pairing properties and enzymatic stability. Nucleic Acids Res. Sep. 25, 1992;20(18):4711-6.
Chen et al., Functionalization of single-walled carbon nanotubes enables efficient intracellular delivery of siRNA targeting MDM2 to inhibit breast cancer cells growth. Biomed Pharmacother. Jul. 2012;66(5):334-8. doi: 10.1016/j.biopha.2011.12.005. Epub Feb. 17, 2012.
Chen et al., Nanoparticles modified with tumor-targeting scFv deliver siRNA and miRNA for cancer therapy. Mol Ther. Sep. 2010;18(9):1650-6. doi: 10.1038/mt.2010.136. Epub Jul. 6, 2010.
Chiang et al., Antisense oligonucleotides inhibit intercellular adhesion molecule 1 expression by two distinct mechanisms. J Biol Chem. Sep. 25, 1991;266(27):18162-71.
Fisher et al., Intracellular disposition and metabolism of fluorescently-labeled unmodified and modified oligonucleotides microinjected into mammalian cells. Nucleic Acids Res. Aug. 11, 1993;21(16):3857-65.
Ortigão et al., Antisense effect of oligodeoxynucleotides with inverted terminal internucleotidic linkages: a minimal modification protecting against nucleolytic degradation. Antisense Res Dev. 1992 Summer;2(2):129-46.
Snead et al., RNA interference trigger variants: getting the most out of RNA for RNA interference-based therapeutics. Nucleic Acid Ther. Jun. 2012;22(3):139-46. doi: 10.1089/nat.2012.0361. Review.
Stein et al., A specificity comparison of four antisense types: morpholino, 2'-O-methyl RNA, DNA, and phosphorothioate DNA. Antisense Nucleic Acid Drug Dev. Jun. 1997;7(3):151-7.
Summerton et al., Morpholino and phosphorothioate antisense oligomers compared in cell-free and in-cell systems. Antisense Nucleic Acid Drug Dev. Apr. 1997;7(2):63-70.
U.S. Appl. No. 15/041,738, filed Feb. 11, 2016, Khvorova et al.
U.S. Appl. No. 15/099,481, filed Apr. 14, 2016, Khvorova et al.
U.S. Appl. No. 15/101,770, filed Jun. 3, 2016, Cauwenbergh et al.
U.S. Appl. No. 15/286,948, filed Oct. 6, 2016, Kamens et al.
U.S. Appl. No. 14/104,450, filed Dec. 12, 2013, Khvorova et al.
U.S. Appl. No. 14/278,900, filed May 15, 2014, Khvorova et al.

(56) References Cited

OTHER PUBLICATIONS

U.S. Appl. No. 15/532,804, filed Jun. 2, 2017, Cauwenbergh et al.
U.S. Appl. No. 15/742,093, filed Jan. 5, 2018, Cardia et al.
U.S. Appl. No. 15/742,117, filed Jan. 5, 2018, Byrne et al.
U.S. Appl. No. 15/905,118, filed Feb. 26, 2018, Khvorova et al.
U.S. Appl. No. 15/508,768, filed Mar. 3, 2017, Cauwenbergh.
U.S. Appl. No. 15/638,586, filed Jun. 30, 2017, Woolf et al.
U.S. Appl. No. 13/636,755, filed Sep. 24, 2012, Khvorova et al.
PCT/US2009/005247, dated Jan. 29, 2010, Invitation to Pay Additional Fees.
PCT/US2009/005247, dated Apr. 16, 2010, International Search Report and Written Opinion.
PCT/US2009/005247, dated Mar. 31, 2011, International Preliminary Report on Patentability.
Alahari et al., Inhibition of expression of the multidrug resistance-associated P-glycoprotein of by phosphorothioate and 5' cholesterol-conjugated phosphorothioate antisense oligonucleotides. Mol Pharmacol. Oct. 1996;50(4):808-19.
Hosono et at., Properties of base-pairing in the stern region of hairpin antisense oligonucleotides containing 2'-methoxynucleosides. Biochim Biophys Acta. Jun. 9, 1995;1244(2-3):339-44.

\* cited by examiner

Figure 10
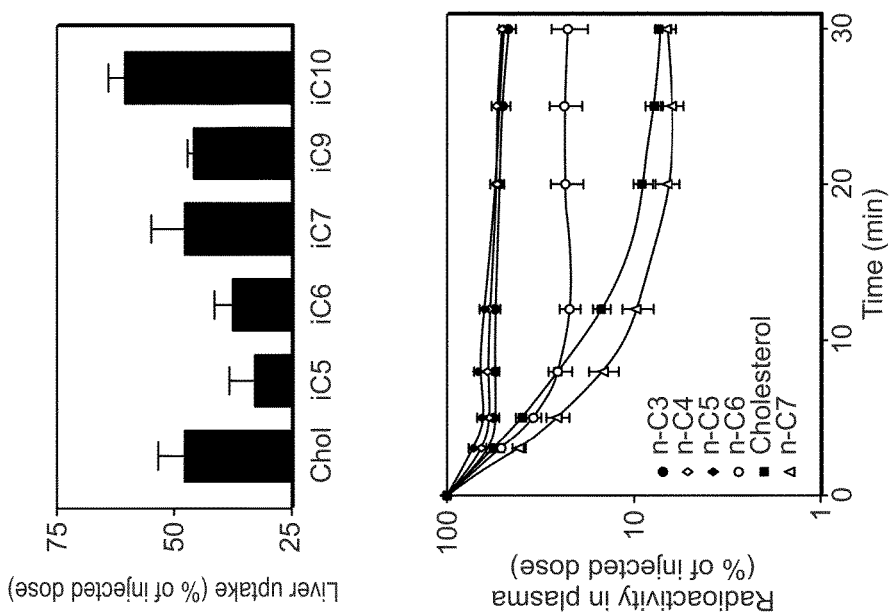
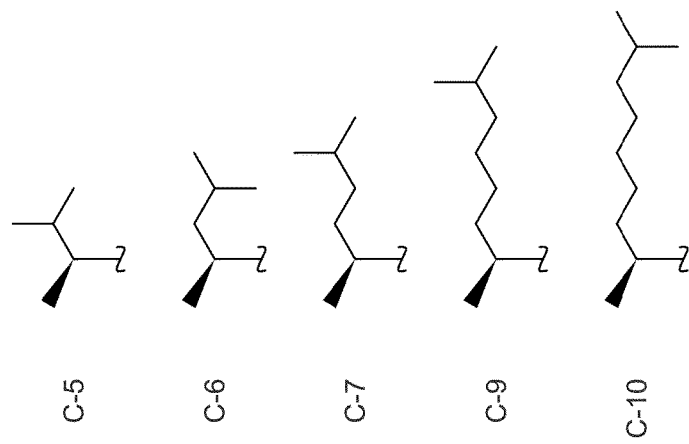
C-5
C-6
C-7
C-9
C-10

Structural Elucidation-MAP4K4

MAP4K4 Targeting Structure Testing

MAP4K4 Minimum Length RNAiTrigger

Structural Elucidation-SOD1

SOD1 Targeting Structure Testing

SOD1 Minimum Length RNAi Trigger 4 to 10 Phosphorothioates Tolerated in GS (19 mer)

SS Modifications

Key
* Phosphorothioate
● 2' F
○ LNA

Figure 51 sd-rxRNA™: Spontaneous Cellular Uptake and Efficacy Without Delivery Vehicle

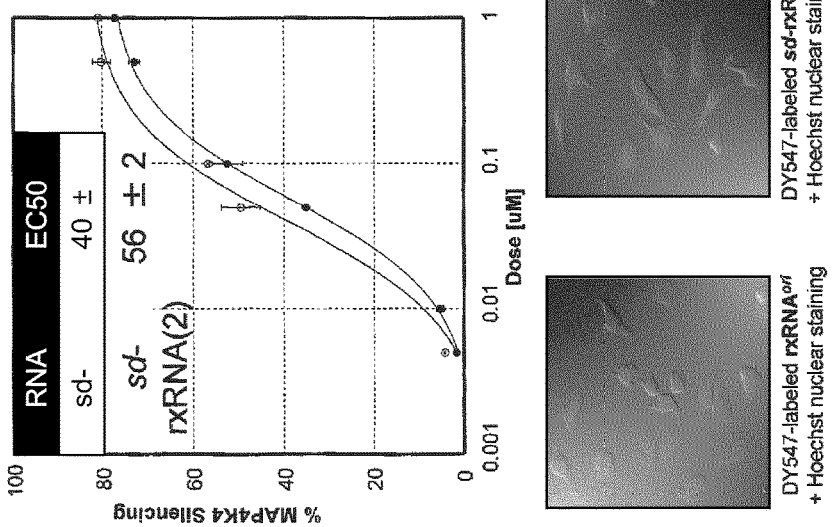

- Chemically modified bipartite RNAi molecules with self-delivering moiety(s)
- *Picomolar* activity after facilitated delivery (lipid-mediated transfection)
- *Nanomolar* activity in cell culture with NO transfection reagent (self-delivery)
- Efficient uptake (>95%) by most cell types in cell culture
- Stable (more then 3 days in 100% human serum)
- Results in distribution to tissues; reduced kidney clearance
- Compatible with SC administration
- Highly specific (little or no immune induction)

sd-rxRNA™: Spontaneous Uptake and Target Gene Silencing in Primary Cells

- Target knockdown after spontaneous cellular uptake in mouse primary hepatocytes

Figure 62
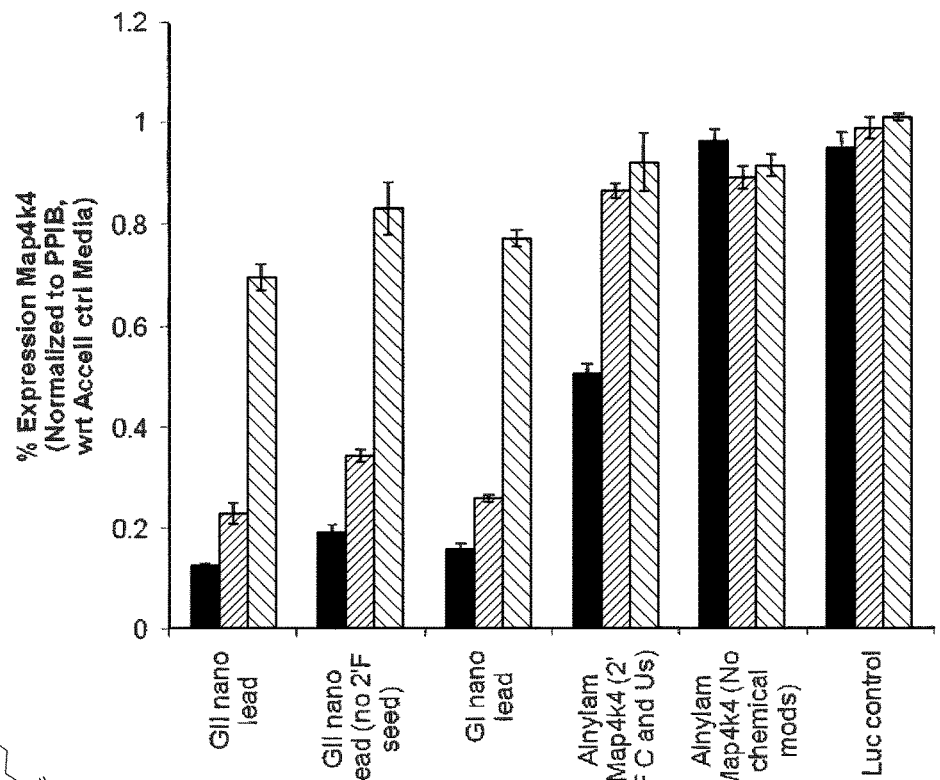
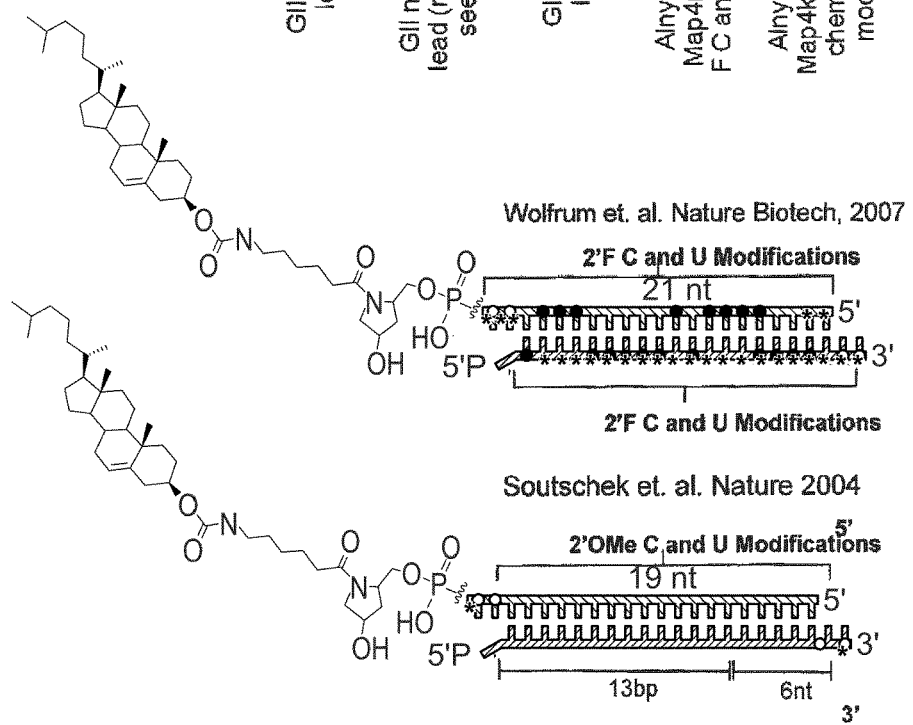

Figure 64
sd-rxRNA™ but not Competitor Molecules Are Internalized within Minutes
sd-rxRNA™
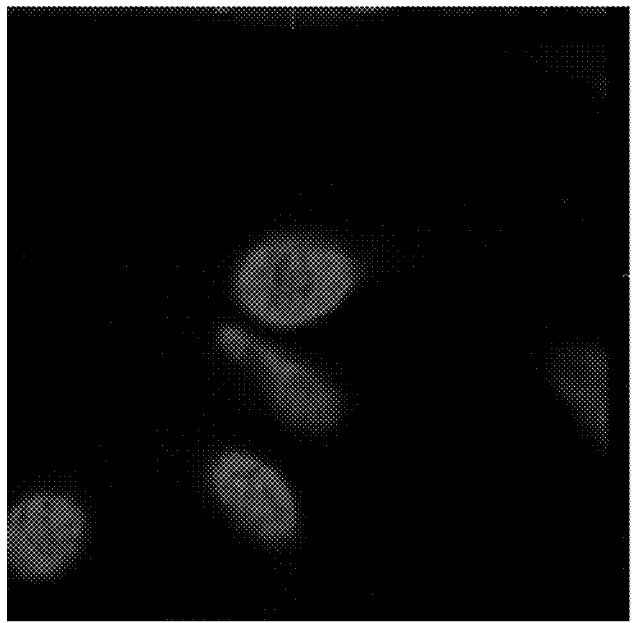
Competing conjugate* RNAs
*Soutschek et al (2004) *Nature*, 432:173
< 5 minutes exposure (HeLa cells)

Local Delivery of sd-rxRNA™: Pilot Study

Figure 77
sd-rxRNA*nano* vs. Competitor: Systemic Delivery to the Liver
Competitor conjugate*
*Soutschek et al (2004) *Nature*, 432:173
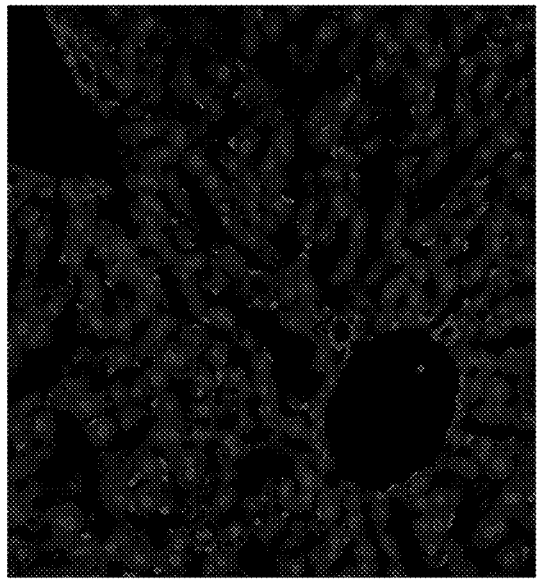
gain =400; 50 mg/kg
sd-rxRNA*nano*
gain = 380; 50 mg/kg

US 10,041,073 B2

REDUCED SIZE SELF-DELIVERING RNAI COMPOUNDS

RELATED APPLICATIONS

This application claims the benefit under 35 U.S.C. § 120, as a Continuation in Part, of U.S. application Ser. No. 13/120,342 entitled "Reduced Size Self-delivering RNAi Compounds," filed on Mar. 22, 2011, which is a national stage filing under 35 U.S.C. § 371 of international application PCT/US2009/005247, filed Sep. 22, 2009, which was published under PCT Article 21(20) in English, and claims the benefit under 35 U.S.C. § 119(e) of U.S. provisional application Ser. No. U.S. 61/192,954, entitled "Chemically Modified Polynucleotides and Methods of Using the Same," filed on Sep. 22, 2008, U.S. 61/149,946, entitled "Minimum Length Triggers of RNA Interference," filed on Feb. 4, 2009, and U.S. 61/224,031, entitled "Minimum Length Triggers of RNA Interference," filed on Jul. 8, 2009, the disclosure of each of which is incorporated by reference herein in its entirety.

FIELD OF INVENTION

The invention pertains to the field of RNA interference (RNAi). The invention more specifically relates to nucleic acid molecules with improved in vivo delivery properties without the use of a delivering agent and their use in efficient gene silencing.

BACKGROUND OF INVENTION

Complementary oligonucleotide sequences are promising therapeutic agents and useful research tools in elucidating gene functions. However, prior art oligonucleotide molecules suffer from several problems that may impede their clinical development, and frequently make it difficult to achieve intended efficient inhibition of gene expression (including protein synthesis) using such compositions in vivo.

A major problem has been the delivery of these compounds to cells and tissues. Conventional double-stranded RNAi compounds, 19-29 bases long, form a highly negatively-charged rigid helix of approximately 1.5 by 10-15 nm in size. This rod type molecule cannot get through the cell-membrane and as a result has very limited efficacy both in vitro and in vivo. As a result, all conventional RNAi compounds require some kind of a delivery vehicle to promote their tissue distribution and cellular uptake. This is considered to be a major limitation of the RNAi technology.

There have been previous attempts to apply chemical modifications to oligonucleotides to improve their cellular uptake properties. One such modification was the attachment of a cholesterol molecule to the oligonucleotide. A first report on this approach was by Letsinger et al., in 1989. Subsequently, ISIS Pharmaceuticals, Inc. (Carlsbad, Calif.) reported on more advanced techniques in attaching the cholesterol molecule to the oligonucleotide (Manoharan, 1992).

With the discovery of siRNAs in the late nineties, similar types of modifications were attempted on these molecules to enhance their delivery profiles. Cholesterol molecules conjugated to slightly modified (Soutschek, 2004) and heavily modified (Wolfrum, 2007) siRNAs appeared in the literature. Yamada et al., 2008 also reported on the use of advanced linker chemistries which further improved cholesterol mediated uptake of siRNAs. In spite of all this effort, the uptake of these types of compounds appears to be inhibited in the presence of biological fluids resulting in highly limited efficacy in gene silencing in vivo, limiting the applicability of these compounds in a clinical setting.

Therefore, it would be of great benefit to improve upon the prior art oligonucleotides by designing oligonucleotides that have improved delivery properties in vivo and are clinically meaningful.

SUMMARY OF INVENTION

Described herein are asymmetric chemically modified nucleic acid molecules with minimal double stranded regions, and the use of such molecules in gene expression modulation. RNAi molecules associated with the invention contain single stranded regions and double stranded regions, and can contain a variety of chemical modifications within both the single stranded and double stranded regions of the molecule. Additionally, the RNAi molecules can be attached to a hydrophobic conjugate such as a conventional and advanced sterol-type molecule. This new class of RNAi molecules has superior efficacy both in vitro and in vivo than previously described RNAi molecules.

Aspects of the invention relate to an isolated nucleic acid molecule having a guide strand of 18-23 nucleotides in length that has complementarity to a miRNA sequence and a passenger strand of 8-16 nucleotides in length. The guide strand and the passenger strand form the nucleic acid molecule such that the nucleic acid has a double stranded region and a single stranded region, wherein the single stranded region is the 3' end of the guide strand and is 2-13 nucleotides in length and comprises at least two phosphorothioate modifications. At least 50% of the pyrimidines in the nucleic acid molecule are modified.

In some embodiments the nucleotide in position one of the guide strand has a 2'-O-methyl modification. For example, the nucleotide in position one of the guide strand may be a 5P-2'O-methyl U.

In other embodiments, at least 60%, 65%, 70%, 75%, 80%, 85%, 90%, 95%, 98% or 99% of the pyrimidines in the nucleic acid molecule are modified. 100% of the pyrimidines in the nucleic acid molecule are modified in other embodiments. The modified pyrimidines may be, for instance, 2'fluoro or 2'O methyl modified.

In some embodiments at least one U or C includes a hydrophobic modification. In other embodiments a plurality of U's and/or C's include a hydrophobic modification. The hydrophobic modification may be, for instance, a methyl or ethyl hydrophobic base modification.

The guide strand may include a number of phosphate backbone modifications, such as phosphorothioate modifications. The guide strand contains 6-8 phosphorothioate modifications in some embodiments. In other embodiments the 3' terminal 10 nucleotides of the guide strand include at least eight phosphorothioate modifications. In yet other embodiments the guide strand includes 4-14 phosphate modifications. These modifications may be on the single stranded region, the double stranded region or both.

The nucleic acid molecule includes a single stranded and a double stranded region. The single stranded region of the guide strand, in some embodiments, is 6 nucleotides long. In other embodiments the single stranded region of the guide strand is 8 nucleotides long. The double stranded region may be 12-14 or 13 nucleotides long in other embodiments.

Optionally, the double stranded nucleic acid molecule has one end that is blunt or includes a one nucleotide overhang.

The passenger strand is linked at the 3' end to a lipophilic group according to some embodiments. The lipophilic group may be a sterol, such as cholesterol.

The isolated double stranded nucleic acid molecule in some embodiments is an miRNA mimic. The miRNA sequence to which the guide strand is complementary in the miRNA mimic is a miRNA recognition element. In some embodiments the miRNA mimic is a mimic of an miRNA selected from the group consisting of miR21, miR 139, miR 7, miR29, miR 122, miR 302-367 cluster, miR 221, miR-96, miR 126, miR 225 and miR 206.

In other embodiments the isolated double stranded nucleic acid molecule is an miRNA inhibitor. The miRNA sequence to which the guide strand is complementary in the miRNA inhibitor is an antisense strand of a mature miRNA. In some embodiments the guide strand is at least 50% chemically modified. In other embodiments the mature miRNA is miR 17-92.

According to aspects of the invention, a method for modulating miRNA-mediated gene expression in a mammalian cell is provided. The method involves contacting the mammalian cell with an isolated double stranded nucleic acid molecule described herein in an effective amount to modulate miRNA-mediated gene expression. In some embodiments miRNA-mediated gene expression in the mammalian cell is reduced. In other embodiments miRNA-mediated gene expression in the mammalian cell is increased. The mammalian cell may contacted with the isolated nucleic acid in vivo, ex vivo, or in vitro.

The invention also involves in other aspects a method for modulating miRNA-mediated gene expression in a stem cell. The method involves contacting the stem cell with an isolated double stranded nucleic acid molecule described herein in an effective amount to modulate miRNA-mediated gene expression in the stem cell. The methods are useful for example in promoting or inhibiting stem cell differentiation, tissue remodeling, organ preservation etc.

Each of the limitations of the invention can encompass various embodiments of the invention. It is, therefore, anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways.

BRIEF DESCRIPTION OF DRAWINGS

The accompanying drawings are not intended to be drawn to scale. In the drawings, each identical or nearly identical component that is illustrated in various figures is represented by a like numeral. For purposes of clarity, not every component may be labeled in every drawing. In the drawings:

FIG. 1A depicts adsRNA with extended guide or passenger strands; FIG. 1B depicts adsRNA with length variations of a cell penetrating polynucleotide; FIG. 1C depicts adsRNA with 3' and 5' conjugates; FIG. 1D depicts adsRNAs with mismatches.

FIG. 7A depicts an adsRNA molecule; FIG. 7B depicts an siRNA molecule of approximately 17-30 bp long; FIG. 7C depicts a RISC entering strand; FIG. 7D depicts a substrate analog strand. Chemical modification patterns, as depicted in FIG. 7, can be optimized to promote desired function.

FIG. 10 presents schematics and graphs demonstrating that the percentage of liver uptake and plasma clearance of lipid emulsions containing sterol type molecules is directly affected by the size of the polycarbon chain attached at position 17. This figure is adapted from Martins et al, Journal of Lipid Research (1998).

FIG. 11A depicts a polynucleotide with a hydrophobic conjugate; FIG. 11B depicts linoleic acid; FIG. 11C depicts a micelle formed from a mixture of polynucleotides containing hydrophobic conjugates combined with fatty acids.

FIG. 27A demonstrates the results of a systematic screen that revealed that the presence of at least 2-12 phosphorothioates in the guide strand significantly improves uptake; in some embodiments, 4-8 phosphorothioate modifications were found to be preferred. FIG. 27B reveals that the presence or absence of phosphorothioate modifications in the sense strand did not alter efficacy.

FIG. 51 presents a graph indicating EC50 values for MAP4K4 silencing in the presence of sd-rxRNA, and images depicting localization of DY547-labeled rxRNA$^{ori}$ and DY547-labeled sd-rxRNA.

FIG. 62 presents a graph and schematics of RNAi compounds demonstrating the superior performance of sd-rxRNA compounds compared to compounds published by Wolfrum et. al. Nature Biotech, 2007. Both generation I and II compounds (GI and GIIa) developed herein show great efficacy. By contrast, when the chemistry described in Wolfrum et al. (all oligos contain cholesterol conjugated to the 3' end of the sense strand) was applied to the same sequence in a context of conventional siRNA (19 bp duplex with two overhang) the compound was practically inactive. These data emphasize the significance of the combination of chemical modifications and asymmetrical molecules described herein, producing highly effective RNA compounds.

FIG. 64 presents images showing that sd-rxRNA molecules, but not other molecules, are internalized into cells within minutes.

FIG. 65A,B compare uptake in RPE cells, FIG. 65C,D compare uptake upon local administration to skin and FIG. 65E,F compare uptake by the liver upon systemic administration. The level of uptake is at least an order of magnitude higher for the sd-rxRNA compounds relative to the regular siRNA-cholesterol compounds.

FIG. 77 presents images comparing localization of sd-rxRNA and other RNA conjugates following systemic delivery to the liver.

FIG. 78B presents a new type of RNAi compound modification which can be applied to compounds to improve cellular uptake and pharmacokinetic behavior. This type of modification, when applied to sd-rxRNA compounds, may contribute to making such compounds orally available.

DETAILED DESCRIPTION

Figure 1:
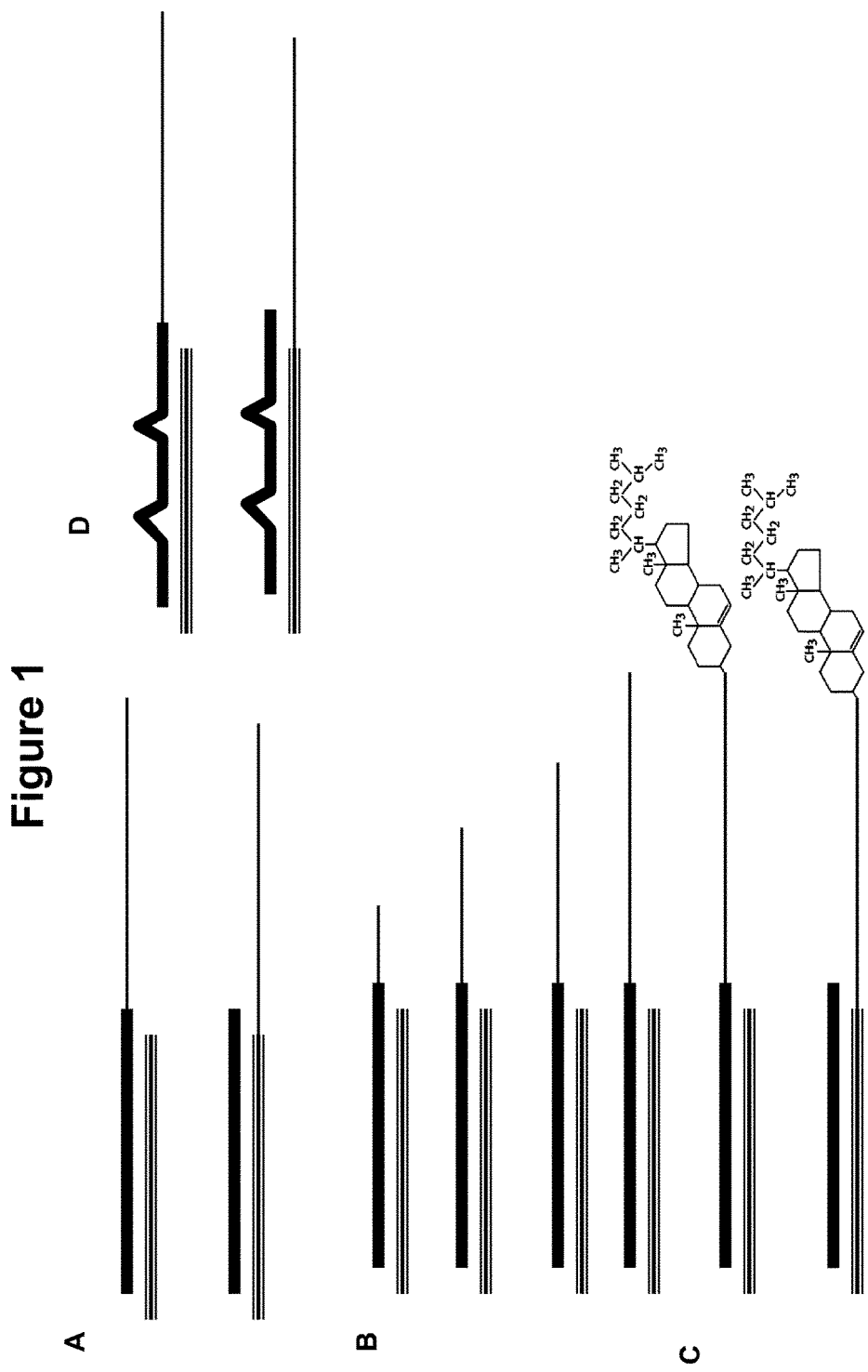
FIG. 1 is a schematic depicting proposed structures of asymmetric double stranded RNA molecules (adsRNA). Bold lines represent sequences carrying modification patterns compatible with RISC loading. Striped lines represent polynucleotides carrying modifications compatible with passenger strands. Plain lines represent a single stranded polynucleotide with modification patterns optimized for cell interaction and uptake.

Aspects of the invention relate to methods and compositions involved in gene silencing. The invention is based at least in part on the surprising discovery that asymmetric nucleic acid molecules with a double stranded region of a minimal length such as 8-14 nucleotides, are effective in silencing gene expression. Molecules with such a short double stranded region have not previously been demonstrated to be effective in mediating RNA interference. It had previously been assumed that that there must be a double stranded region of 19 nucleotides or greater. The molecules described herein are optimized through chemical modification, and in some instances through attachment of hydrophobic conjugates.

The invention is based at least in part on another surprising discovery that asymmetric nucleic acid molecules with reduced double stranded regions are much more effectively taken up by cells compared to conventional siRNAs. These molecules are highly efficient in silencing of target gene expression and offer significant advantages over previously described RNAi molecules including high activity in the presence of serum, efficient self delivery, compatibility with a wide variety of linkers, and reduced presence or complete absence of chemical modifications that are associated with toxicity.

In contrast to single-stranded polynucleotides, duplex polynucleotides have been difficult to deliver to a cell as they have rigid structures and a large number of negative charges which makes membrane transfer difficult. Unexpectedly, it was found that the polynucleotides of the present invention, although partially double-stranded, are recognized in vivo as single-stranded and, as such, are capable of efficiently being delivered across cell membranes. As a result the polynucleotides of the invention are capable in many instances of self delivery. Thus, the polynucleotides of the invention may be formulated in a manner similar to conventional RNAi agents or they may be delivered to the cell or subject alone (or with non-delivery type carriers) and allowed to self deliver. In one embodiment of the present invention, self delivering asymmetric double-stranded RNA molecules are provided in which one portion of the molecule resembles a conventional RNA duplex and a second portion of the molecule is single stranded.

The polynucleotides of the invention are referred to herein as isolated double stranded or duplex nucleic acids, oligonucleotides or polynucleotides, nano molecules, nano RNA, sd-rxRNA$^{nano}$, sd-rxRNA or RNA molecules of the invention.

The oligonucleotides of the invention in some aspects have a combination of asymmetric structures including a double stranded region and a single stranded region of 5 nucleotides or longer, specific chemical modification patterns and are conjugated to lipophilic or hydrophobic molecules. This new class of RNAi like compounds have superior efficacy in vitro and in vivo. Based on the data described herein it is believed that the reduction in the size of the rigid duplex region in combination with phosphorothioate modifications applied to a single stranded region are new and important for achieving the observed superior efficacy. Thus, the RNA molecules described herein are different in both structure and composition as well as in vitro and in vivo activity.

In a preferred embodiment the RNAi compounds of the invention comprise an asymmetric compound comprising a duplex region (required for efficient RISC entry of 10-15 bases long) and single stranded region of 4-12 nucleotides long; with a 13 nucleotide duplex. A 6 nucleotide single stranded region is preferred in some embodiments. The single stranded region of the new RNAi compounds also comprises 2-12 phosphorothioate internucleotide linkages (referred to as phosphorothioate modifications). 6-8 phosphorothioate internucleotide linkages are preferred in some embodiments. Additionally, the RNAi compounds of the invention also include a unique chemical modification pattern, which provides stability and is compatible with RISC entry. The combination of these elements has resulted in unexpected properties which are highly useful for delivery of RNAi reagents in vitro and in vivo.

The chemically modification pattern, which provides stability and is compatible with RISC entry includes modifications to the sense, or passenger, strand as well as the antisense, or guide, strand. For instance the passenger strand can be modified with any chemical entities which confirm stability and do not interfere with activity. Such modifications include 2' ribo modifications (O-methyl, 2' F, 2 deoxy and others) and backbone modification like phosphorothioate modifications. A preferred chemical modification pattern in the passenger strand includes O-methyl modification of C and U nucleotides within the passenger strand or alternatively the passenger strand may be completely O-methyl modified.

The guide strand, for example, may also be modified by any chemical modification which confirms stability without interfering with RISC entry. A preferred chemical modification pattern in the guide strand includes the majority of C and U nucleotides being 2' F modified and the 5' end being phosphorylated. Another preferred chemical modification pattern in the guide strand includes 2'Omethyl modification of position 1 and C/U in positions 11-18 and 5' end chemical phosphorylation. Yet another preferred chemical modification pattern in the guide strand includes 2'Omethyl modification of position 1 and C/U in positions 11-18 and 5' end chemical phosphorylation and 2'F modification of C/U in positions 2-10.

It was surprisingly discovered according to the invention that the above-described chemical modification patterns of the oligonucleotides of the invention are well tolerated and actually improved efficacy of asymmetric RNAi compounds. See, for instance, FIG. 22.

Figure 23:
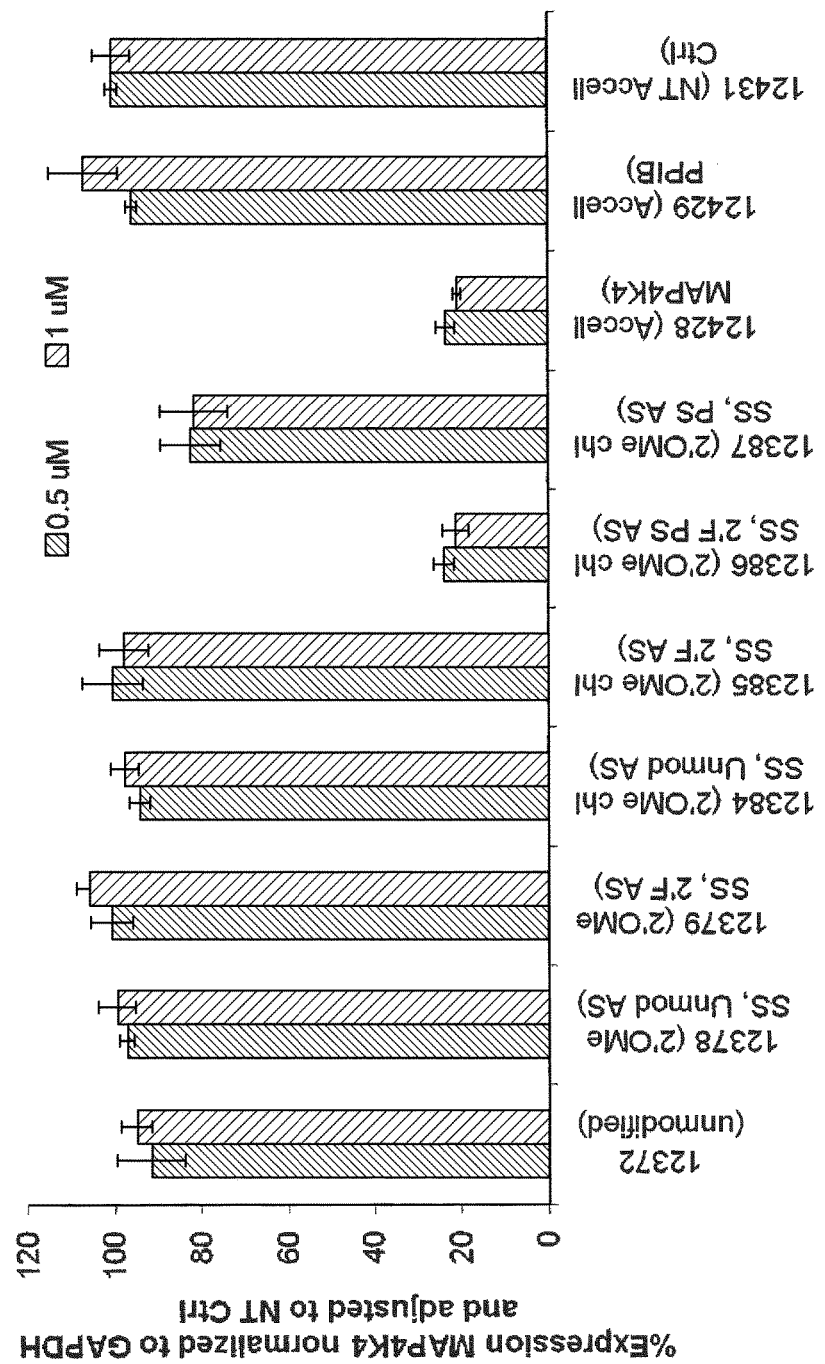
FIG. 23 demonstrates that the chemical modifications described herein significantly increase in vitro efficacy in un-assisted delivery of RNAi molecules in HeLa cells. The structure and sequence of the compounds were not altered; only the chemical modification patterns of the molecules were modified. Compounds lacking 2'F, 2'O-me, phosphorothioate modification, or cholesterol conjugates were completely inactive in passive uptake. A combination of all 4 of these types of modifications produced the highest levels of activity (compound 12386).

It was also demonstrated experimentally herein that the combination of modifications to RNAi when used together in a polynucleotide results in the achievement of optimal efficacy in passive uptake of the RNAi. Elimination of any of the described components (Guide strand stabilization, phosphorothioate stretch, sense strand stabilization and hydrophobic conjugate) or increase in size results in suboptimal efficacy and in some instances complete lost of efficacy. The combination of elements results in development of compound, which is fully active following passive delivery to cells such as HeLa cells. (FIG. 23). The degree to which the combination of elements results in efficient self delivery of RNAi molecules was completely unexpected.

Figure 26:
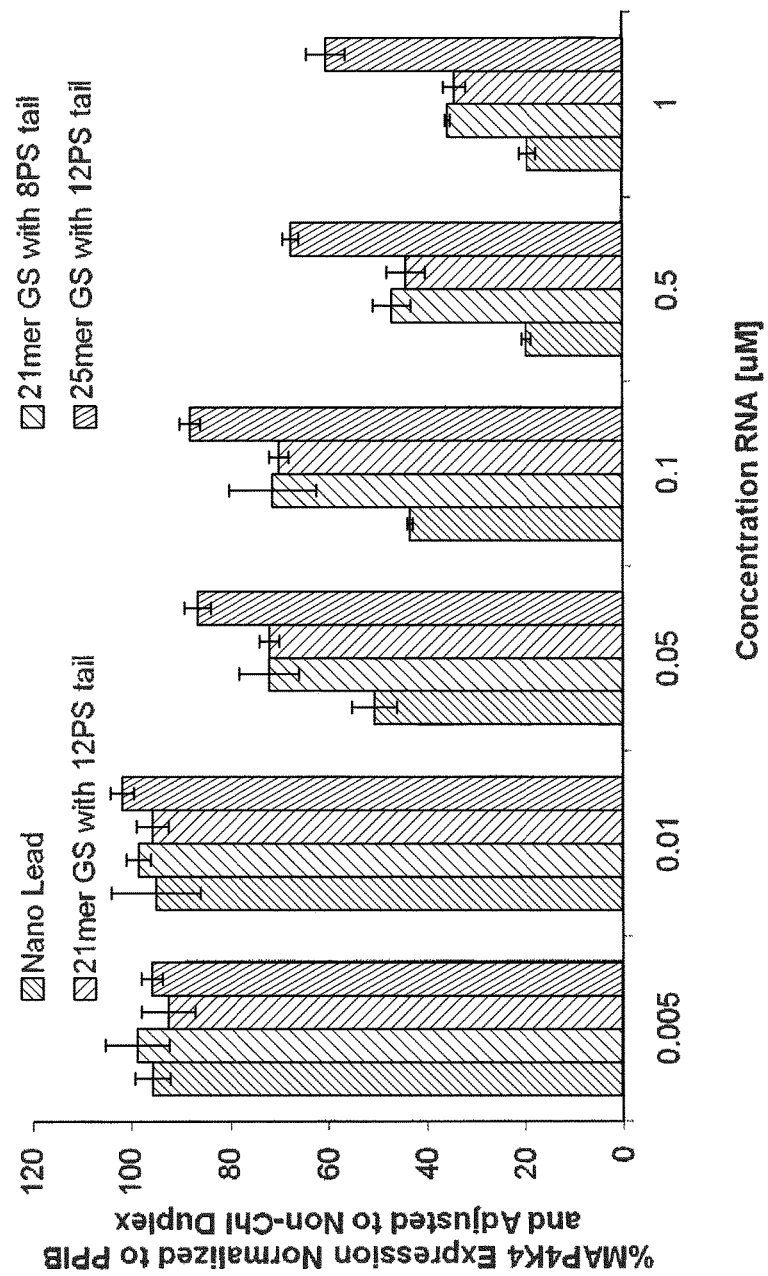
FIG. 26 is a graph demonstrating that reduction in oligonucleotide content increases the efficacy of unassisted uptake. Similar chemical modifications were applied to asymmetric compounds, traditional siRNA compounds and 25mer RNAi compounds. The asymmetric small compounds demonstrated the most significant efficacy.
Figure 27:
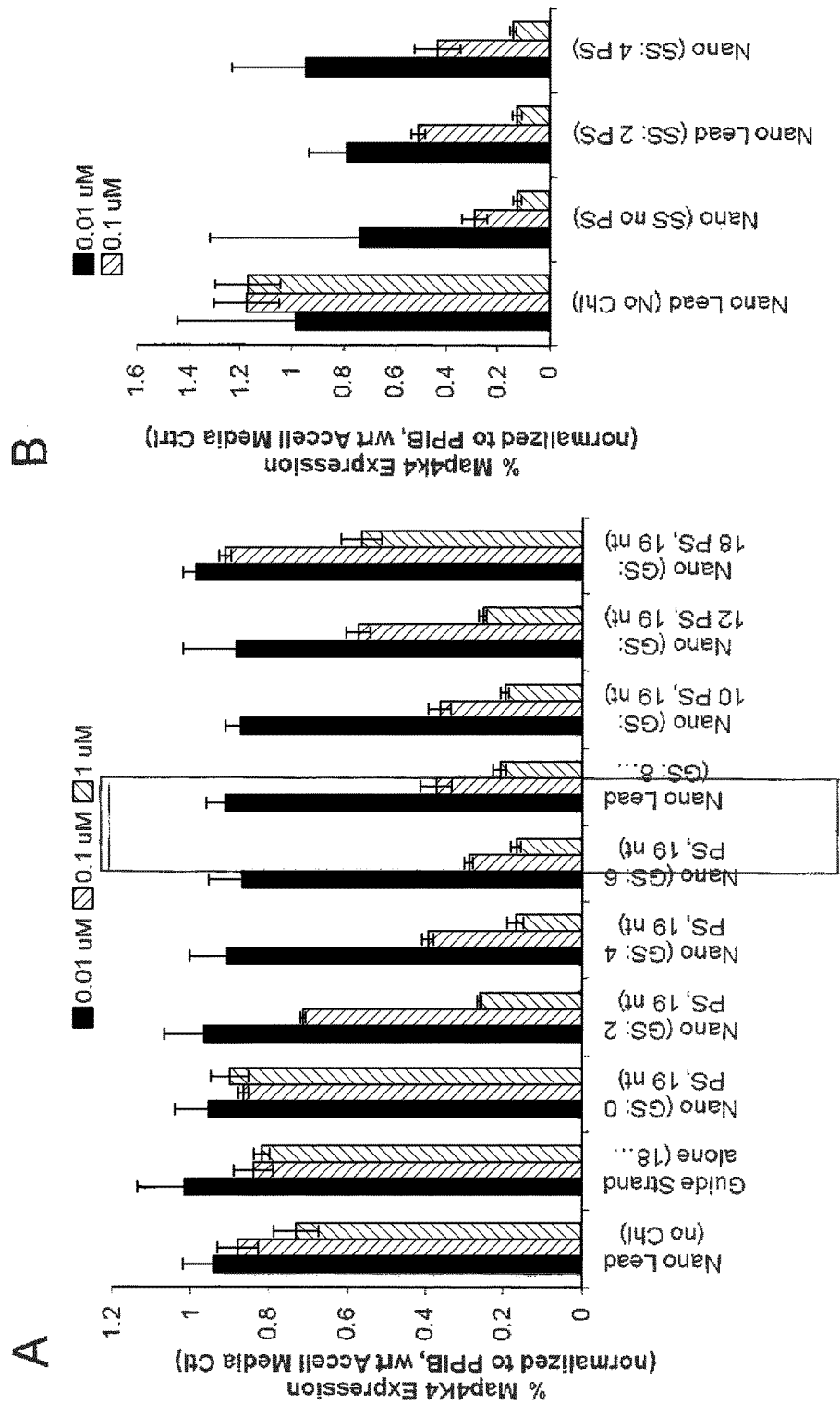
FIG. 27 is a graph demonstrating the importance of phosphorothioate content for un-assisted delivery.
Figure 43:
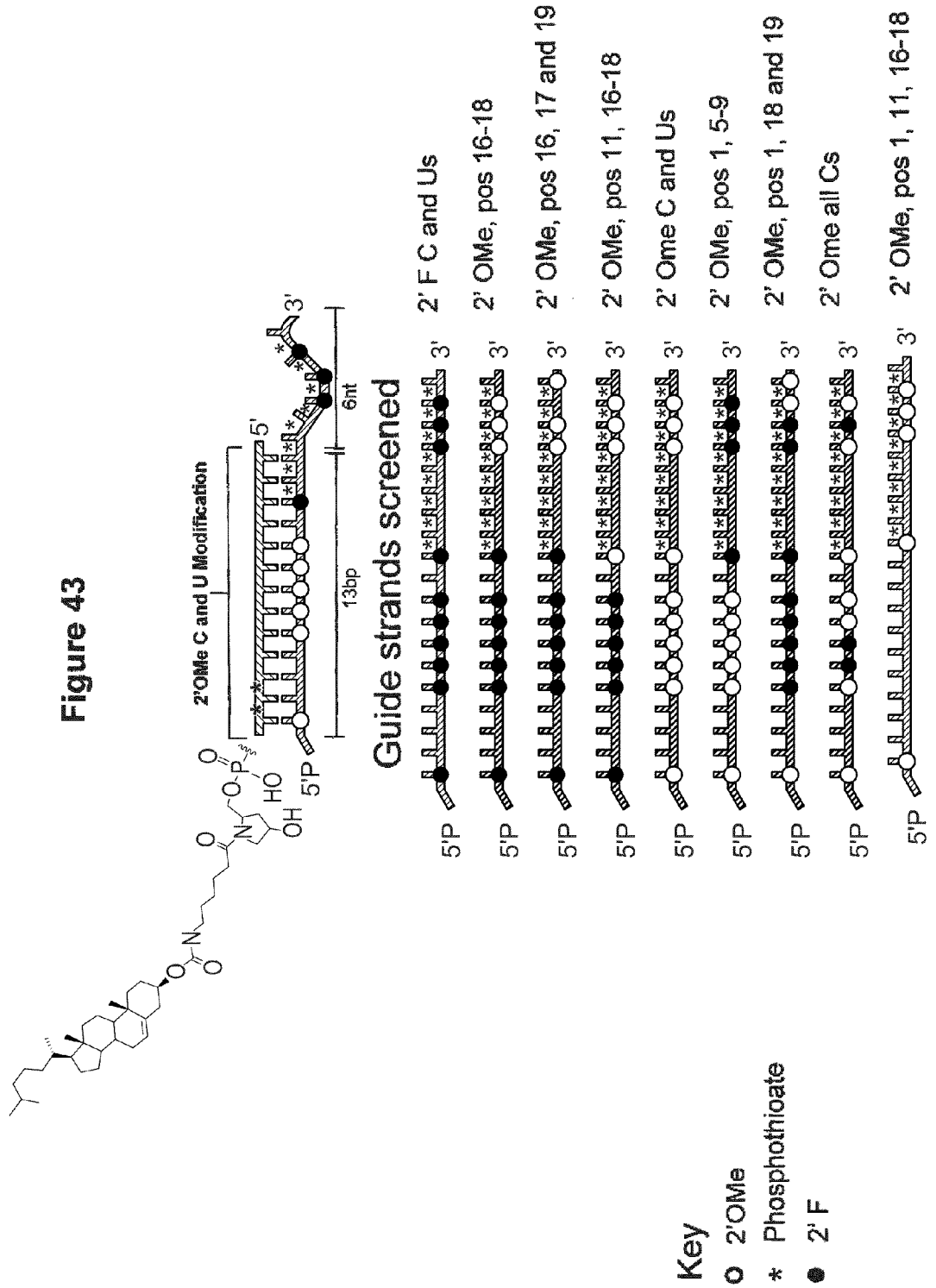
FIG. 43 is a schematic depicting guide strand chemical modifications that were screened for optimization.

The data shown in FIGS. 26, 27 and 43 demonstrated the importance of the various modifications to the RNAi in achieving stabilization and activity. For instance, FIG. 26 demonstrates that use off asymmetric configuration is important in getting efficacy in passive uptake. When the same chemical composition is applied to compounds of traditional configurations (19-21 bases duplex and 25 mer duplex) the efficacy was drastically decreased in a length dependent manner FIG. 27 demonstrated a systematic screen of the impact of phosphorothioate chemical modifications on activity. The sequence, structure, stabilization chemical modifications, hydrophobic conjugate were kept constant and compound phosphorothioate content was varied (from 0 to 18 PS bond). Both compounds having no phosphorothioate linkages and having 18 phosphorothioate linkages were completely inactive in passive uptake. Compounds having 2-16 phosphorothioate linkages were active, with compounds having 4-10 phosphorothioate being the most active compounds.

Figure 65:
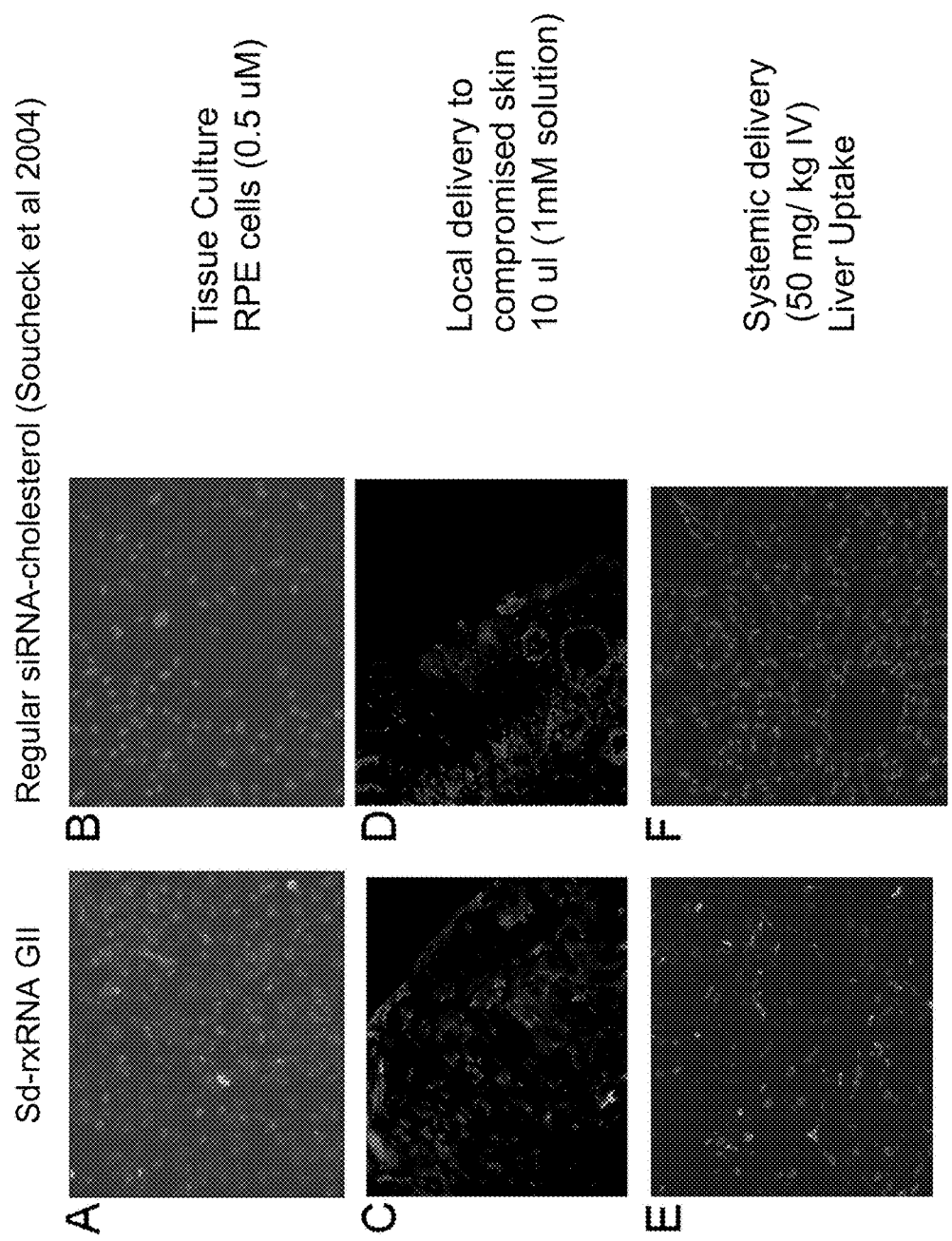
FIG. 65 presents images demonstrating that sd-rxRNA compounds have drastically better cellular and tissue uptake characteristics when compared to conventional cholesterol conjugated siRNAs (such as those published by Soucheck et al).
Figure 68:
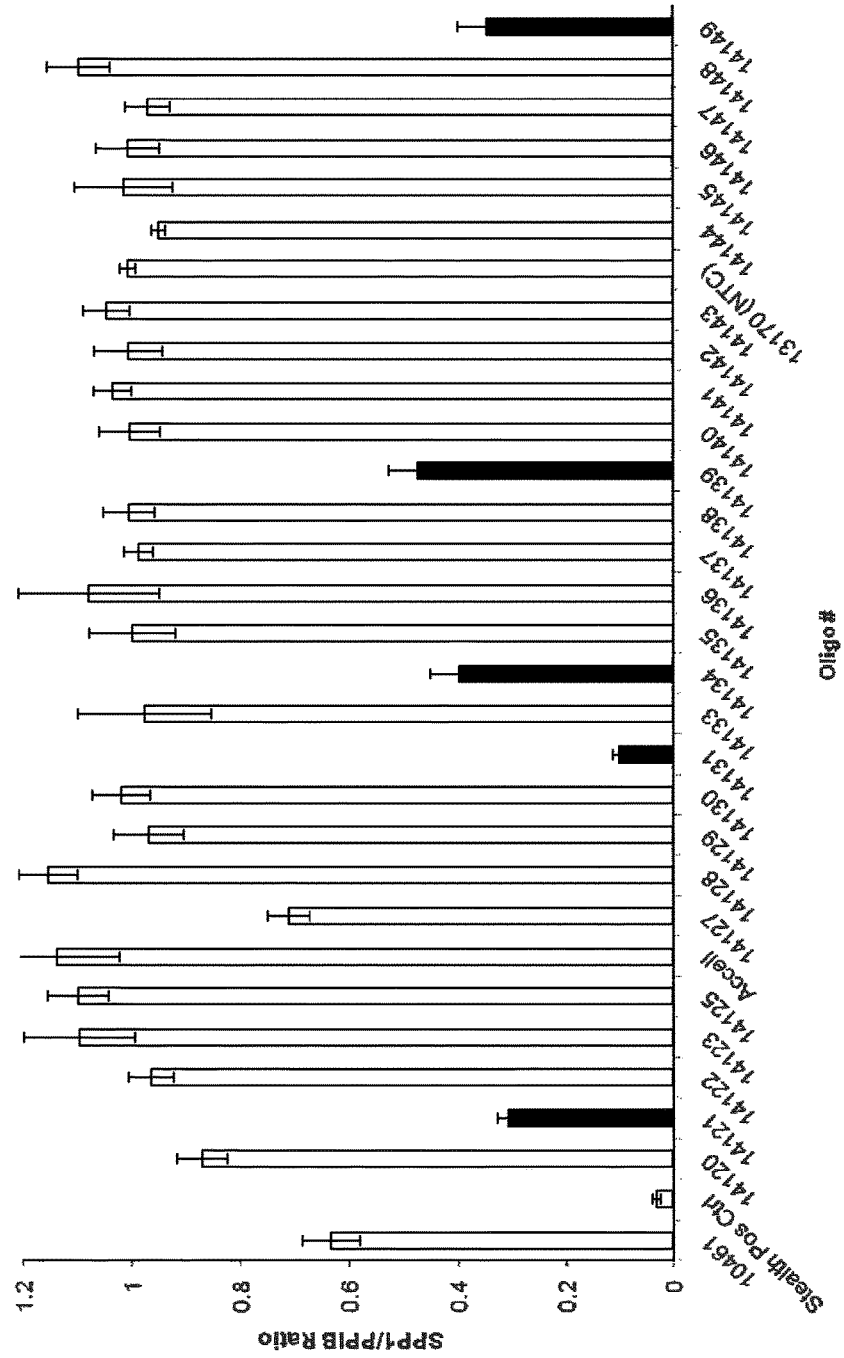
FIG. 68 presents a graph revealing the results of a screen performed with sd-rxRNAGII chemistry to identify functional compounds targeting the SPP1 gene. Multiple effective compounds were identified, with 14131 being the most effective. The compounds were added to A-549 cells and the level of the ratio of SPP1/PPIB was determined by B-DNA after 48 hours.
Figure 70:
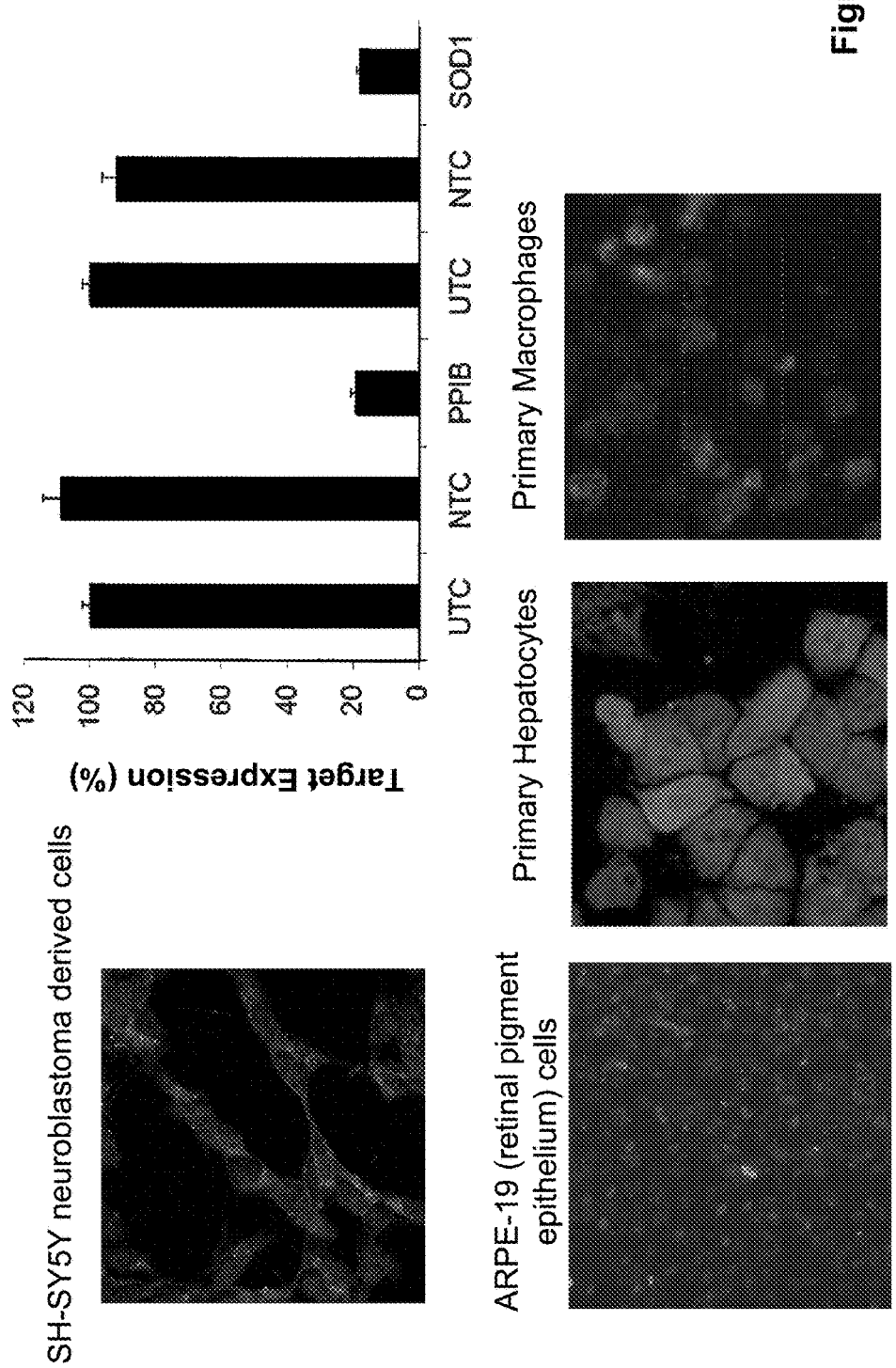
FIG. 70 presents a graph and several images demonstrating efficient uptake and silencing of sd-rxRNA compounds in multiple cell types with multiple sequences. In each case silencing was confirmed by looking at target gene expression using a Branched DNA assay.
Figure 71:
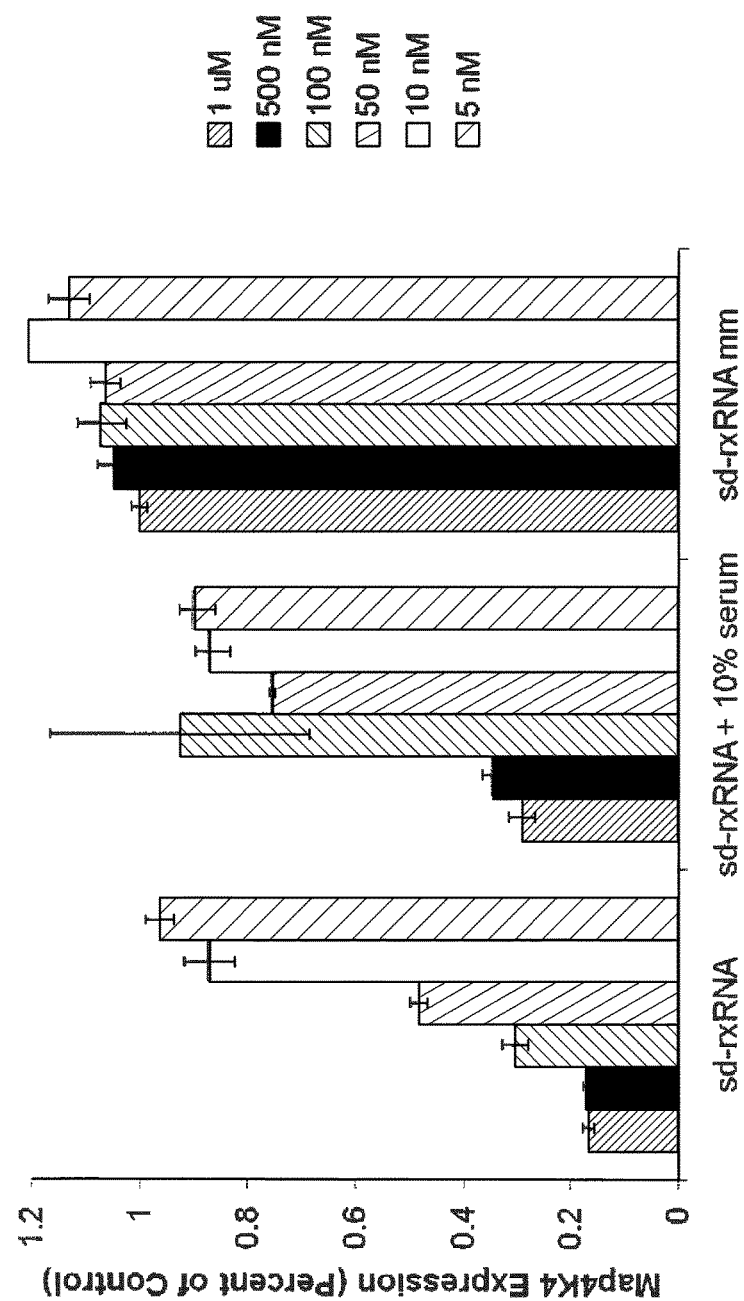
FIG. 71 presents a graph revealing that sd-rxRNA is active in the presence and absence of serum. A slight reduction in efficacy (2-5 fold) was observed in the presence of serum. This minimal reduction in efficacy in the presence of serum differentiates the sd-rxRNA compounds described herein from previously described RNAi compounds, which had a greater reduction in efficacy, and thus creates a foundation for in vivo efficacy of the sd-rxRNA molecules described herein.

The data in the Examples presented below demonstrates high efficacy of the oligonucleotides of the invention both in vitro in variety of cell types (supporting data) and in vivo upon local and systemic administration. For instance, the data compares the ability of several competitive RNAi molecules having different chemistries to silence a gene. Comparison of sd-rxRNA (oligonucleotides of the invention) with RNAs described in Soucheck et al. and Wolfrum at al., as applied to the same targeting region, demonstrated that only sd-rxRNA chemistry showed a significant functionality in passive uptake. The composition of the invention achieved EC50 values of 10-50 pM. This level of efficacy is un-attainable with conventional chemistries like those described in Sautheck at al and Accell. Similar comparisons were made in other systems, such as in vitro (RPE cell line), in vivo upon local administration (wounded skin) and systemic (50 mg/kg) as well as other genes (FIGS. 65 and 68). In each case the oligonucleotides of the invention achieved better results. FIG. 64 includes data demonstrating efficient cellular uptake and resulting silencing by sd-rxRNA compounds only after 1 minute of exposure. Such an efficacy is unique to this composition and have not been seen with other types of molecules in this class. FIG. 70 demonstrates efficient uptake and silencing of sd-rxRNA compounds in multiple cell types with multiple sequences. The sd-rxRNA compounds are also active in cells in presence and absence of serum and other biological liquids. FIG. 71 demonstrates only a slight reduction in activity in the presence of serum. This ability to function in biologically aggressive environment effectively further differentiates sd-rxRNA compounds from other compounds described previously in this group, like Accell and Soucheck et al, in which uptake is drastically inhibited in a presence of serum.

Figure 72:
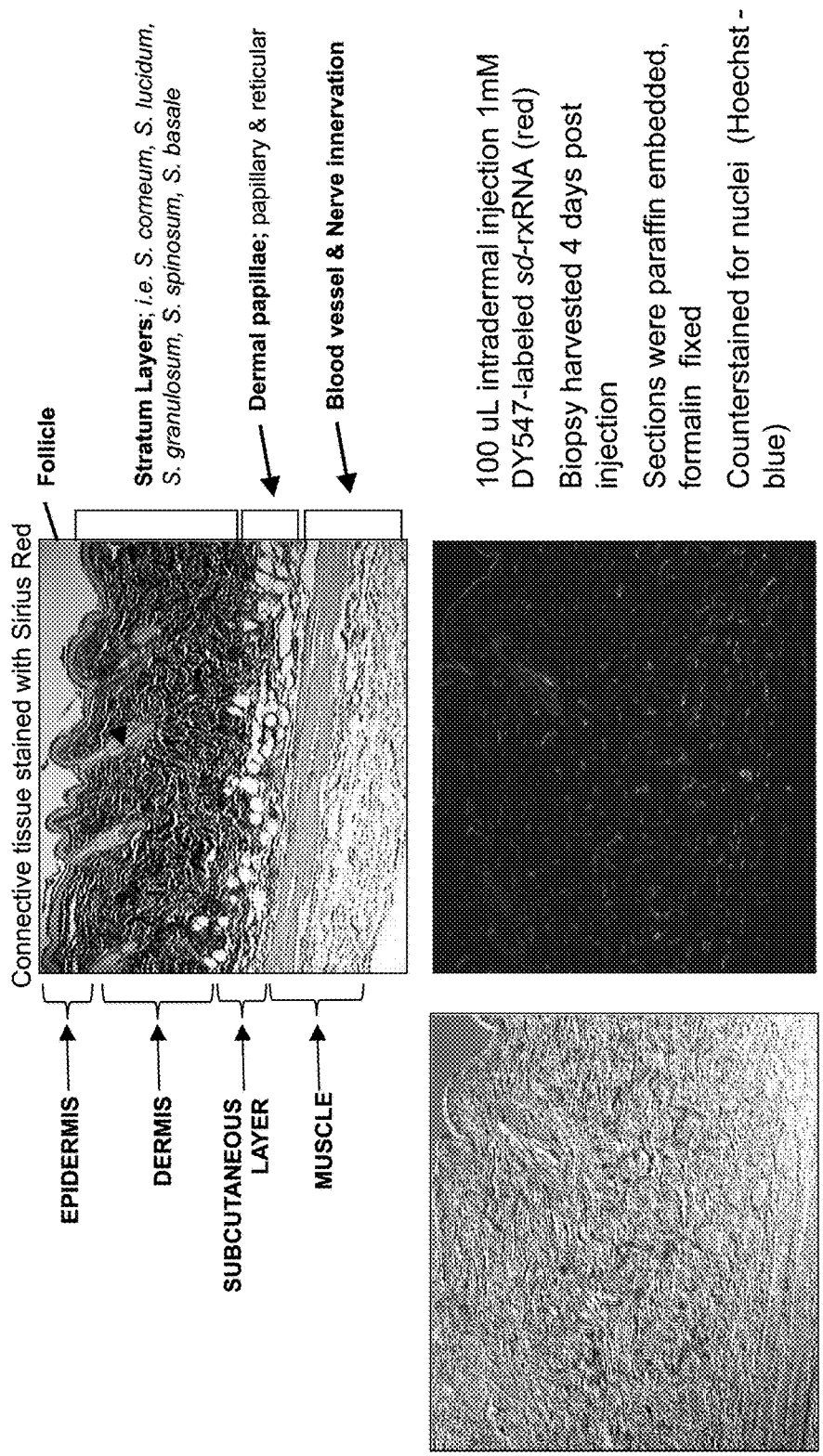
FIG. 72 presents images demonstrating efficient tissue penetration and cellular uptake upon single intradermal injection of sd-rxRNA compounds described herein. This represents a model for local delivery of sd-rxRNA compounds as well as an effective demonstration of delivery of sd-rxRNA compounds and silencing of genes in dermatological applications.
Figure 73:
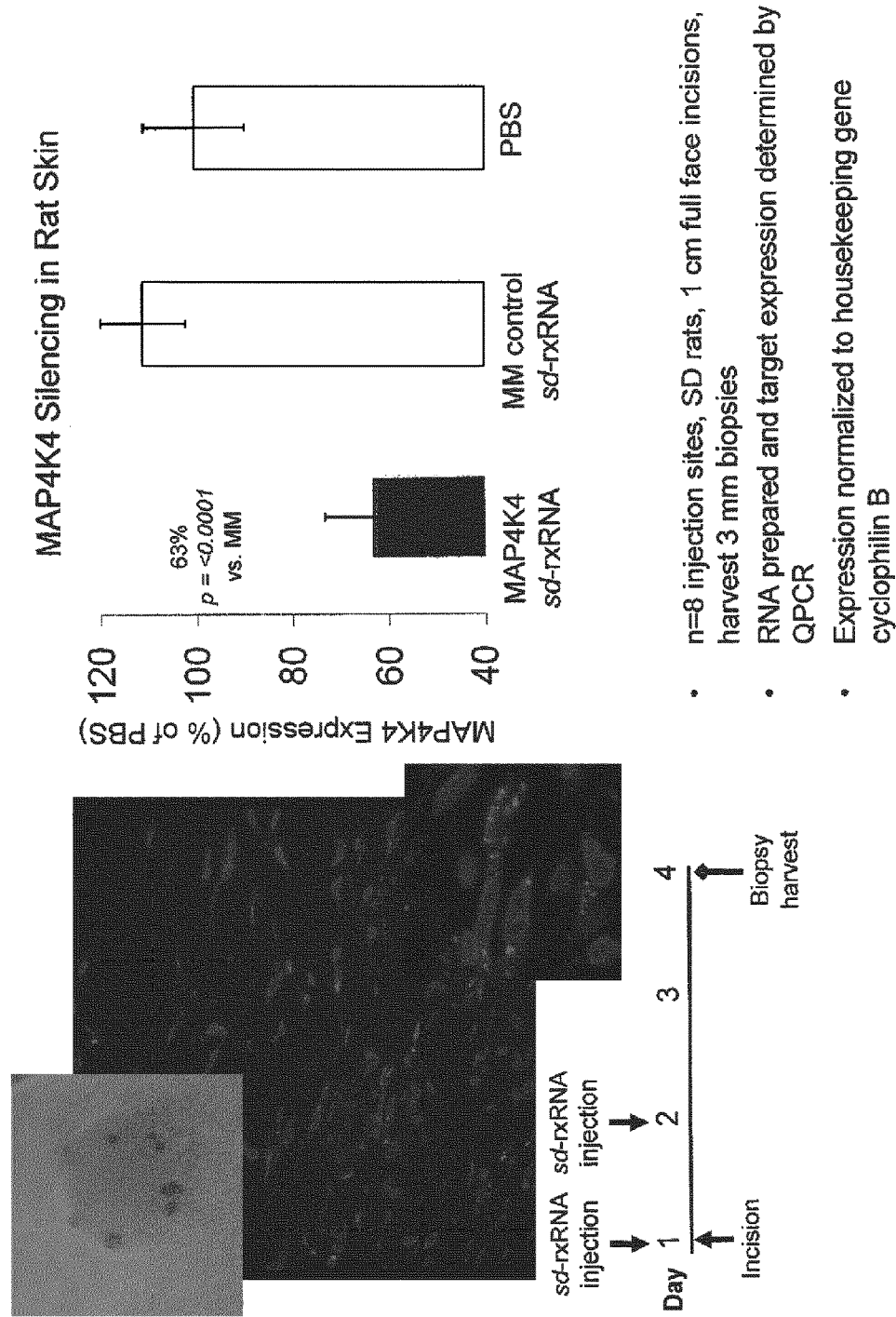
FIG. 73 presents images and a graph demonstrating efficient cellular uptake and in vivo silencing with sd-rxRNA following intradermal injection.

Significant amounts of data also demonstrate the in vivo efficacy of the compounds of the invention. For instance FIGS. 72-74 involve multiple routes of in vivo delivery of the compounds of the invention resulting in significant activity. FIG. 72, for example, demonstrates efficient tissue penetration and cellular uptake upon single intradermal injection. This is a model for local delivery of sd-rxRNA compounds as well as an effective delivery mode for sd-rxRNA compounds and silencing genes in any dermatology applications. FIG. 73 demonstrated efficient tissue penetration, cellular uptake and silencing upon local in vivo intradermal injection of sd-rxRNA compounds. The data of FIG. 74 demonstrate that sd-rxRNA compounds result in highly effective liver uptake upon IV administration. Comparison to Souicheck at al molecule showed that the level of liver uptake at identical dose level was quite surprisingly, at least 50 fold higher with the sd-rxRNA compound than the Souicheck at al molecule.

The sd-rxRNA can be further improved in some instances by improving the hydrophobicity of compounds using of novel types of chemistries. For example one chemistry is related to use of hydrophobic base modifications. Any base in any position might be modified, as long as modification results in an increase of the partition coefficient of the base. The preferred locations for modification chemistries are positions 4 and 5 of the pyrimidines. Preferably the base modification is a methyl or ethyl modification. The major advantage of these positions is (a) ease of synthesis and (b) lack of interference with base-pairing and A form helix formation, which are essential for RISC complex loading and target recognition. Examples of these chemistries is shown in FIGS. 75-83. A version of sd-rxRNA compounds where multiple deoxy Uridines are present without interfering with overall compound efficacy was used. In addition major improvement in tissue distribution and cellular uptake might be obtained by optimizing the structure of the hydrophobic conjugate. In some of the preferred embodiment the structure of sterol is modified to alter (increase/decrease) C17 attached chain. This type of modification results in significant increase in cellular uptake and improvement of tissue uptake prosperities in vivo.

This invention is not limited in its application to the details of construction and the arrangement of components set forth in the following description or illustrated in the drawings. The invention is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

Thus, aspects of the invention relate to isolated double stranded nucleic acid molecules comprising a guide (antisense) strand and a passenger (sense) strand. As used herein, the term "double-stranded" refers to one or more nucleic acid molecules in which at least a portion of the nucleomonomers are complementary and hydrogen bond to form a double-stranded region. In some embodiments, the length of the guide strand ranges from 16-29 nucleotides long. In certain embodiments, the guide strand is 16, 17, 18, 19, 20, 21, 22, 23, 24, 25, 26, 27, 28, or 29 nucleotides long. The guide strand has complementarity to a target gene. Complementarity between the guide strand and the target gene may exist over any portion of the guide strand. Complementarity as used herein may be perfect complementarity or less than perfect complementarity as long as the guide strand is sufficiently complementary to the target that it mediates RNAi. In some embodiments complementarity refers to less than 25%, 20%, 15%, 10%, 5%, 4%, 3%, 2%, or 1% mismatch between the guide strand and the target. Perfect complementarity refers to 100% complementarity. Thus the invention has the advantage of being able to tolerate sequence variations that might be expected due to genetic mutation, strain polymorphism, or evolutionary divergence. For example, siRNA sequences with insertions, deletions, and single point mutations relative to the target sequence have also been found to be effective for inhibition. Moreover, not all positions of a siRNA contribute equally to target recognition. Mismatches in the center of the siRNA are most critical and essentially abolish target RNA cleavage. Mismatches upstream of the center or upstream of the cleavage site referencing the antisense strand are tolerated but significantly reduce target RNA cleavage. Mismatches downstream of the center or cleavage site referencing the antisense strand, preferably located near the 3' end of the antisense strand, e.g. 1, 2, 3, 4, 5 or 6 nucleotides from the 3' end of the antisense strand, are tolerated and reduce target RNA cleavage only slightly.

While not wishing to be bound by any particular theory, in some embodiments, the guide strand is at least 16 nucleotides in length and anchors the Argonaute protein in RISC. In some embodiments, when the guide strand loads into RISC it has a defined seed region and target mRNA cleavage takes place across from position 10-11 of the guide strand. In some embodiments, the 5' end of the guide strand is or is able to be phosphorylated. The nucleic acid molecules described herein may be referred to as minimum trigger RNA.

In some embodiments, the length of the passenger strand ranges from 8-14 nucleotides long. In certain embodiments, the passenger strand is 8, 9, 10, 11, 12, 13 or 14 nucleotides long. The passenger strand has complementarity to the guide strand. Complementarity between the passenger strand and the guide strand can exist over any portion of the passenger or guide strand. In some embodiments, there is 100% complementarity between the guide and passenger strands within the double stranded region of the molecule.

Aspects of the invention relate to double stranded nucleic acid molecules with minimal double stranded regions. In some embodiments the region of the molecule that is double stranded ranges from 8-14 nucleotides long. In certain embodiments, the region of the molecule that is double stranded is 8, 9, 10, 11, 12, 13 or 14 nucleotides long. In certain embodiments the double stranded region is 13 nucleotides long. There can be 100% complementarity between the guide and passenger strands, or there may be one or more mismatches between the guide and passenger strands. In some embodiments, on one end of the double stranded molecule, the molecule is either blunt-ended or has a one-nucleotide overhang. The single stranded region of the molecule is in some embodiments between 4-12 nucleotides long. For example the single stranded region can be 4, 5, 6, 7, 8, 9, 10, 11 or 12 nucleotides long. However, in certain embodiments, the single stranded region can also be less than 4 or greater than 12 nucleotides long. In certain embodiments, the single stranded region is 6 nucleotides long.

RNAi constructs associated with the invention can have a thermodynamic stability ($\Delta G$) of less than −13 kkal/mol. In some embodiments, the thermodynamic stability ($\Delta G$) is less than −20 kkal/mol. In some embodiments there is a loss of efficacy when ($\Delta G$) goes below −21 kkal/mol. In some embodiments a ($\Delta G$) value higher than −13 kkal/mol is compatible with aspects of the invention. Without wishing to be bound by any theory, in some embodiments a molecule with a relatively higher ($\Delta G$) value may become active at a relatively higher concentration, while a molecule with a relatively lower ($\Delta G$) value may become active at a relatively lower concentration. In some embodiments, the ($\Delta G$) value may be higher than −9 kkcal/mol. The gene silencing effects mediated by the RNAi constructs associated with the invention, containing minimal double stranded regions, are unexpected because molecules of almost identical design but lower thermodynamic stability have been demonstrated to be inactive (Rana et al 2004).

Without wishing to be bound by any theory, results described herein suggest that a stretch of 8-10 bp of dsRNA or dsDNA will be structurally recognized by protein components of RISC or co-factors of RISC. Additionally, there is a free energy requirement for the triggering compound that it may be either sensed by the protein components and/or stable enough to interact with such components so that it may be loaded into the Argonaute protein. If optimal thermodynamics are present and there is a double stranded portion that is preferably at least 8 nucleotides then the duplex will be recognized and loaded into the RNAi machinery.

In some embodiments, thermodynamic stability is increased through the use of LNA bases. In some embodiments, additional chemical modifications are introduced. Several non-limiting examples of chemical modifications include: 5' Phosphate, 2'-O-methyl, 2'-O-ethyl, 2'-fluoro, ribothymidine, C-5 propynyl-dC (pdC) and C-5 propynyl-dU (pdU); C-5 propynyl-C (pC) and C-5 propynyl-U (pU); 5-methyl C, 5-methyl U, 5-methyl dC, 5-methyl dU methoxy, (2,6-diaminopurine), 5'-Dimethoxytrityl-N4-ethyl-2'-deoxyCytidine and MGB (minor groove binder). It should be appreciated that more than one chemical modification can be combined within the same molecule.

Molecules associated with the invention are optimized for increased potency and/or reduced toxicity. For example, nucleotide length of the guide and/or passenger strand, and/or the number of phosphorothioate modifications in the guide and/or passenger strand, can in some aspects influence potency of the RNA molecule, while replacing 2'-fluoro (2'F) modifications with 2'-O-methyl (2'OMe) modifications can in some aspects influence toxicity of the molecule. Specifically, reduction in 2'F content of a molecule is predicted to reduce toxicity of the molecule. The Examples section presents molecules in which 2'F modifications have been eliminated, offering an advantage over previously described RNAi compounds due to a predicted reduction in toxicity. Furthermore, the number of phosphorothioate modifications in an RNA molecule can influence the uptake of the molecule into a cell, for example the efficiency of passive uptake of the molecule into a cell. Preferred embodiments of molecules described herein have no 2'F modification and yet are characterized by equal efficacy in cellular uptake and tissue penetration. Such molecules represent a significant improvement over prior art, such as molecules described by Accell and Wolfrum, which are heavily modified with extensive use of 2'F.

In some embodiments, a guide strand is approximately 18-19 nucleotides in length and has approximately 2-14 phosphate modifications. For example, a guide strand can contain 2, 3, 4, 5, 6, 7, 8, 9, 10, 11, 12, 13, 14 or more than 14 nucleotides that are phosphate-modified. The guide strand may contain one or more modifications that confer increased stability without interfering with RISC entry. The phosphate modified nucleotides, such as phosphorothioate modified nucleotides, can be at the 3' end, 5' end or spread throughout the guide strand. In some embodiments, the 3' terminal 10 nucleotides of the guide strand contains 1, 2, 3, 4, 5, 6, 7, 8, 9 or 10 phosphorothioate modified nucleotides. The guide strand can also contain 2'F and/or 2'OMe modifications, which can be located throughout the molecule. In some embodiments, the nucleotide in position one of the guide strand (the nucleotide in the most 5' position of the guide strand) is 2'OMe modified and/or phosphorylated. C and U nucleotides within the guide strand can be 2'F modified. For example, C and U nucleotides in positions 2-10 of a 19 nt guide strand (or corresponding positions in a guide strand of a different length) can be 2'F modified. C and U nucleotides within the guide strand can also be 2'OMe modified. For example, C and U nucleotides in positions 11-18 of a 19 nt guide strand (or corresponding positions in a guide strand of a different length) can be 2'OMe modified. In some embodiments, the nucleotide at the most 3' end of the guide strand is unmodified. In certain embodiments, the majority of Cs and Us within the guide strand are 2'F modified and the 5' end of the guide strand is phosphorylated. In other embodiments, position 1 and the Cs or Us in positions 11-18 are 2'OMe modified and the 5' end of the guide strand is phosphorylated. In other embodiments, position 1 and the Cs or Us in positions 11-18 are 2'OMe modified, the 5' end of the guide strand is phosphorylated, and the Cs or Us in position 2-10 are 2'F modified.

In some aspects, an optimal passenger strand is approximately 11-14 nucleotides in length. The passenger strand may contain modifications that confer increased stability. One or more nucleotides in the passenger strand can be 2'OMe modified. In some embodiments, one or more of the C and/or U nucleotides in the passenger strand is 2'OMe modified, or all of the C and U nucleotides in the passenger strand are 2'OMe modified. In certain embodiments, all of the nucleotides in the passenger strand are 2'OMe modified. One or more of the nucleotides on the passenger strand can also be phosphate-modified such as phosphorothioate modified. The passenger strand can also contain 2' ribo, 2'F and 2 deoxy modifications or any combination of the above. As demonstrated in the Examples, chemical modification patterns on both the guide and passenger strand are well tolerated and a combination of chemical modifications is shown herein to lead to increased efficacy and self-delivery of RNA molecules.

Aspects of the invention relate to RNAi constructs that have extended single-stranded regions relative to double stranded regions, as compared to molecules that have been used previously for RNAi. The single stranded region of the molecules may be modified to promote cellular uptake or gene silencing. In some embodiments, phosphorothioate modification of the single stranded region influences cellular uptake and/or gene silencing. The region of the guide strand that is phosphorothioate modified can include nucleotides within both the single stranded and double stranded regions of the molecule. In some embodiments, the single stranded region includes 2-12 phosphorothioate modifications. For example, the single stranded region can include 2, 3, 4, 5, 6, 7, 8, 9, 10, 11, or 12 phosphorothioate modifications. In some instances, the single stranded region contains 6-8 phosphorothioate modifications.

Molecules associated with the invention are also optimized for cellular uptake. In RNA molecules described herein, the guide and/or passenger strands can be attached to a conjugate. In certain embodiments the conjugate is hydrophobic. The hydrophobic conjugate can be a small molecule with a partition coefficient that is higher than 10. The conjugate can be a sterol-type molecule such as cholesterol, or a molecule with an increased length polycarbon chain attached to C17, and the presence of a conjugate can influence the ability of an RNA molecule to be taken into a cell with or without a lipid transfection reagent. The conjugate can be attached to the passenger or guide strand through a hydrophobic linker. In some embodiments, a hydrophobic linker is 5-12C in length, and/or is hydroxypyrrolidine-based. In some embodiments, a hydrophobic conjugate is attached to the passenger strand and the CU residues of either the passenger and/or guide strand are modified. In some embodiments, at least 50%, 55%, 60%, 65%, 70%, 75%, 80%, 85%, 90% or 95% of the CU residues on the passenger strand and/or the guide strand are modified. In some aspects, molecules associated with the invention are self-delivering (sd). As used herein, "self-delivery" refers to the ability of a molecule to be delivered into a cell without the need for an additional delivery vehicle such as a transfection reagent.

Aspects of the invention relate to selecting molecules for use in RNAi. Based on the data described herein, molecules that have a double stranded region of 8-14 nucleotides can be selected for use in RNAi. In some embodiments, molecules are selected based on their thermodynamic stability ($\Delta G$). In some embodiments, molecules will be selected that have a ($\Delta G$) of less than −13 kkal/mol. For example, the ($\Delta G$) value may be −13, −14, −15, −16, −17, −18, −19, −21, −22 or less than −22 kkal/mol. In other embodiments, the ($\Delta G$) value may be higher than −13 kkal/mol. For example, the ($\Delta G$) value may be −12, −11, −10, −9, −8, −7 or more than −7 kkal/mol. It should be appreciated that $\Delta G$ can be calculated using any method known in the art. In some embodiments $\Delta G$ is calculated using Mfold, available through the Mfold internet site (http://mfold.bioinfo.rpi.edu/cgi-bin/rna-form1.cgi). Methods for calculating $\Delta G$ are described in, and are incorporated by reference from, the following references: Zuker, M. (2003) Nucleic Acids Res., 31(13):3406-15; Mathews, D. H., Sabina, J., Zuker, M. and Turner, D. H. (1999) J. Mol. Biol. 288:911-940; Mathews, D. H., Disney, M. D., Childs, J. L., Schroeder, S. J., Zuker, M., and Turner, D. H. (2004) Proc. Natl. Acad. Sci. 101:

7287-7292; Duan, S., Mathews, D. H., and Turner, D. H. (2006) Biochemistry 45:9819-9832; Wuchty, S., Fontana, W., Hofacker, I. L., and Schuster, P. (1999) Biopolymers 49:145-165.

Aspects of the invention relate to using nucleic acid molecules described herein, with minimal double stranded regions and/or with a (ΔG) of less than −13 kkal/mol, for gene silencing. RNAi molecules can be administered in vivo or in vitro, and gene silencing effects can be achieved in vivo or in vitro.

In certain embodiments, the polynucleotide contains 5'- and/or 3'-end overhangs. The number and/or sequence of nucleotides overhang on one end of the polynucleotide may be the same or different from the other end of the polynucleotide. In certain embodiments, one or more of the overhang nucleotides may contain chemical modification(s), such as phosphorothioate or 2'-OMe modification.

In certain embodiments, the polynucleotide is unmodified. In other embodiments, at least one nucleotide is modified. In further embodiments, the modification includes a 2'-H or 2'-modified ribose sugar at the 2nd nucleotide from the 5'-end of the guide sequence. The "2nd nucleotide" is defined as the second nucleotide from the 5'-end of the polynucleotide.

As used herein, "2'-modified ribose sugar" includes those ribose sugars that do not have a 2'-OH group. "2'-modified ribose sugar" does not include 2'-deoxyribose (found in unmodified canonical DNA nucleotides). For example, the 2'-modified ribose sugar may be 21-O-alkyl nucleotides, 2'-deoxy-2'-fluoro nucleotides, 2'-deoxy nucleotides, or combination thereof.

In certain embodiments, the 2'-modified nucleotides are pyrimidine nucleotides (e.g., C/U). Examples of 2'-O-alkyl nucleotides include 2'-O-methyl nucleotides, or 2'-O-allyl nucleotides.

In certain embodiments, the miniRNA polynucleotide of the invention with the above-referenced 5'-end modification exhibits significantly (e.g., at least about 25%, 30%, 35%, 40%, 45%, 50%, 55%, 60%, 65%, 70%, 75%, 80%, 85%, 90% or more) less "off-target" gene silencing when compared to similar constructs without the specified 5'-end modification, thus greatly improving the overall specificity of the RNAi reagent or therapeutics.

As used herein, "off-target" gene silencing refers to unintended gene silencing due to, for example, spurious sequence homology between the antisense (guide) sequence and the unintended target mRNA sequence.

According to this aspect of the invention, certain guide strand modifications further increase nuclease stability, and/ or lower interferon induction, without significantly decreasing RNAi activity (or no decrease in RNAi activity at all).

In some embodiments, the 5'-stem sequence may comprise a 2'-modified ribose sugar, such as 2'-O-methyl modified nucleotide, at the $2^{nd}$ nucleotide on the 5'-end of the polynucleotide and, in some embodiments, no other modified nucleotides. The hairpin structure having such modification may have enhanced target specificity or reduced off-target silencing compared to a similar construct without the 2'-O-methyl modification at said position.

Certain combinations of specific 5'-stem sequence and 3'-stem sequence modifications may result in further unexpected advantages, as partly manifested by enhanced ability to inhibit target gene expression, enhanced serum stability, and/or increased target specificity, etc.

In certain embodiments, the guide strand comprises a 2'-O-methyl modified nucleotide at the $2^{nd}$ nucleotide on the 5'-end of the guide strand and no other modified nucleotides.

In other aspects, the miniRNA structures of the present invention mediates sequence-dependent gene silencing by a microRNA mechanism. As used herein, the term "microRNA" ("miRNA"), also referred to in the art as "small temporal RNAs" ("stRNAs"), refers to a small (10-50 nucleotide) RNA which are genetically encoded (e.g., by viral, mammalian, or plant genomes) and are capable of directing or mediating RNA silencing. An "miRNA disorder" shall refer to a disease or disorder characterized by an aberrant expression or activity of an miRNA.

miRNAs are important modulators of cellular homeostasis and differention. Reduced levels of miRNA expression or excessive expression of miRNA have been shown to be involved in many diseases. microRNAs are involved in down-regulating target genes in critical pathways, such as development and cancer, in mice, worms and mammals. In particular significant reduction of different miRNA expression is related to tumor development and progression. Gene silencing through a microRNA mechanism is achieved by specific yet, in some cases, imperfect base-pairing of the miRNA and its target messenger RNA (mRNA). Various mechanisms may be used in microRNA-mediated downregulation of target mRNA expression.

miRNAs are noncoding RNAs of approximately 22 nucleotides which can regulate gene expression at the post transcriptional or translational level during plant and animal development. One common feature of miRNAs is that they are all excised from an approximately 70 nucleotide precursor RNA stem-loop termed pre-miRNA, probably by Dicer, an RNase III-type enzyme, or a homolog thereof. Naturally-occurring miRNAs are expressed by endogenous genes in vivo and are processed from a hairpin or stem-loop precursor (pre-miRNA or pri-miRNAs) by Dicer or other RNAses. miRNAs can exist transiently in vivo as a double-stranded duplex but only one strand is taken up by the RISC complex to direct gene silencing.

In some embodiments a version of sd-rxRNA compounds, which are effective in cellular uptake and modulating miRNA activity are described. Essentially the compounds are similar to RISC entering version but large strand chemical modification patterns are optimized in the way to block cleavage and act as an effective inhibitor of the RISC action. For example, the compound might be completely or mostly O-methyl modified with the PS content described previously. For these types of compounds the 5' phosphorylation is not necessary. The presence of double stranded region is preferred as it is promotes cellular uptake and efficient RISC loading.

Finding a way to modulate miRNA expression is an important unresolved problem in miRNA based drug development. The invention describes novel miRNA modulating compounds (miRNA mimics and miRNA inhibitors). The miRNA modulating compounds of the invention have the same basic structural properties described herein for self delivering RNA. Exemplary, non-limiting, sequences of the miRNA modulating compounds of the invention are shown in Tables 4-5.

In general, the miRNA modulating compounds have two strands, a guide (or antisense) strand that is 18-23 bases long and a passenger (or sense) strand that is 8-16 bases long. The size difference of the two strands results in a double stranded and a single strand region of the molecule. In some embodiments the single stranded region is substantially modified, for example, with phosphorothioates. The presence of this phosphorothioated region is believed to be important for improved PK/PD, tissue distribution and cellular uptake properties of these molecules.

In some instances it is preferred that the first position of the guide strand has a 2'O-methyl modification such as a 5P-2 o-methyl U. The presence of this modification in the guide strand further promotes the association with and loading into RISC complex.

Preferably both strands of the miRNA modulators are extensively modified, as described herein. For instance many of the pyrimidines are preferably 2' modified. These modifications contribute to the stability of the molecule.

Additionally the overall hydrophobicity of the miRNA modulating compounds of the invention is increased to enhance cellular entry. This may be accomplished through the presence of some hydrophobic modification in the bases. For instance, position 5 or 4 of uridines and cytidine may include hydrophobic base modifications. These modifications increase and promote RISC association, stability, specificity and cellular entry. An example of a preferred hydrophobic base modification is methyl or ethyl. The presence of these type of modifications appear to not interfere with RISC entry of the miRNA modulating compounds and actually seem to promotes RISC entry.

In addition to hydrophobic base modification, other hydrophobic moieties may be linked to the molecule. A preferred location for linkage of hydrophobic moieties is the 3' end position of the passenger strand.

The compounds of the invention having these structural properties are excellent modulators of miRNA expression in vivo. Administration of these compounds is expected to mimic natural miRNA expression in a targeted cells or inhibit undesirable miRNA, depending on the specificity of the guide strand. These compounds are useful in modulating miRNA level and activity in many tissues, such as brain, spinal cord, tumors, liver, lung, kidney skin, heart, vasculature, and spleen. Additionally these compounds may be used ex vivo and in primary, dentritic or stem cells to modulate cellular properties prior to introduction or reintroduction of the cells into a subject. For instance they may be used in dendritic cells or primary tumors to help with a cancer vaccine development. The compounds may be used in stem cells or tissues or organs ex vivo or in vitro to promote or stop stem cells differentiation, tissue remodeling, organ preservation and many other applications.

The miRNA modulating compounds of the invention are miRNA mimics or miRNA inhibitors. An miRNA mimic as used herein refers to a double stranded nucleic acid having a guide strand that has a nucleic acid sequence that is similar, or in some cases identical, to a guide strand of a naturally occurring mature miRNA. Naturally occurring miRNA are processed from long nucleic acids having secondary structural properties (referred to as pri-miRNA and pre-miRNA) to produce naturally occurring mature miRNA. The mature miRNA is a double stranded molecule of about 22 nucleotides in length having a guide strand that binds to an miRNA recognition element (MRE) in the 3' untranslated region (UTR) of a target mRNA (in a RISC complex) and suppresses its translation or initiates degradation of the mRNA.

The miRNA mimic of the invention includes a guide strand that is identical to or similar to the sequence of a guide strand of a naturally occurring mature miRNA. Identical to the sequence, as used herein refers to the same nucleic acid bases in the nucleotide as are found in the mature miRNA. Similar to the sequence, in this context, refers to a nucleic acid molecule having a sequence which is less than identical but at least 75% homologous to the mature miRNA. In some instances "similar to the sequence" refers to a sequence which is less than identical but at least 70%, 75%, 80%, 85%, 90%, 91%, 92%, 93%, 94%, 95%, 96%, 97%, 98%, or 99% homologous to the mature miRNA. In some cases the sequence of the miRNA mimic may include the same bases, but the base of the mimic may be modified, i.e. hydrophobically modified. In other cases the mimic may include one or more different bases or nucleotides than the naturally occurring mature miRNA.

The guide strand of the miRNA mimic is complementary to a miRNA recognition element (MRE). "Complementary to a miRNA recognition element" as used herein refers to base complementarity between at least 6 or 7 nucleotides of the miRNA mimic guide strand (preferably the 5' end of the guide strand) and the MRE. The region of complementarity is referred to as the seed region. In some embodiments the seed region or region of complementarity is 6, 7, 8, 9, 10, 11, 12 or 13 nucleotides in length. The complementarity of the seed region may be perfect (100%) or may be less i.e. greater than 90%, 95%, 96%, 97%, 98%, or 99%, but preferably is 100%. The complementarity between the entire miRNA and the MRE may be greater than 80%, 85%, 90%, 91%, 92%, 93%, 94%, 95%, 96%, 97%, 98%, or 99%.

The miRNA mimics of the invention are useful for mimicking the activity of any naturally occurring miRNA. Non-limiting examples include: miR21, miR 139, miR 7, miR29, miR 122, miR 302-367 cluster, miR 221, miR-96, miR 126, miR 225 and miR 206.

An miRNA inhibitor as used herein refers to a double stranded nucleic acid having a guide strand that has a nucleic acid sequence that is complementary to a guide strand or antisense strand of a naturally occurring mature miRNA. "Complementary to an antisense strand of a naturally occurring mature miRNA" as used herein refers to base complementarity between the guide strand of the inhibitor and the antisense strand of the naturally occurring mature miRNA. In some embodiments the complementarity may be perfect (100%) or may be less than perfect i.e. greater than 80%, 85%, 90%, 95%, 96%, 97%, 98%, or 99% complementarity. The guide strand of the miRNA inhibitor is extensively chemically modified (i.e. with O-methyls or other modification), to prevent its entry into RISC. The association of the miRNA inhibitor guide strand with the naturally occurring (or miRNA mimic guide strand) miRNA loaded RISC is enhanced by the chemical modifications and sequence complementarily, such that it competes for binding with the naturally occurring mRNA.

The structure and function of miRNAs has been the subject of extensive research and several miRNAs have been sequenced and investigated regarding their function in human disease. Some non-limiting examples of known human miRNAs, the expression of which can be modulated with agents and methods provided herein are let-7, let-7a-1, let-7a-2, let-7a-3, let-7b, let-7c, let-7d, let-7e, let-7f-1, let-7f-2, let-7g, let-7i, mir-1, mir-10, mir-100, mir-101, mir-101-1, mir-101-2, mir-103, mir-103-1, mir-103-2, mir-105, mir-105-1, mir-105-2, mir-106a, mir-106b, mir-107, mir-10a, mir-10b, mir-1-1, mir-1-2, mir-124, mir-124-1, mir-124-2, mir-124-3, mir-125, mir-125a, mir-125b-1, mir-125b-2, mir-128, mir-128a, mir-128b, mir-129, mir-129-1, mir-129-2, mir-130, mir-130a, mir-130b, mir-132, mir-132, mir-133, mir-133a-1, mir-133a-2, mir-133b, mir-135, mir-135a-1, mir-135a-2, mir-135b, mir-138, mir-138-1, mir-138-2, mir-141, mir-146, mir-146a, mir-146b, mir-147, mir-147a, mir-147b, mir-148, mir-148a, mir-148b, mir-15, mir-151, mir-152, mir-153, mir-153-1, mir-153-2, mir-154, mir-154, mir-15a, mir-15b, mir-16-1, mir-16-2, mir-17, mir-181, mir-181a-1, mir-181a-2, mir-181b-1, mir-181b-2, mir-181c, mir-181d, mir-188, mir-188, mir-18a, mir-18b, mir-19, mir-190, mir-190, mir-190b, mir-192, mir-192, mir-193, mir- 193a, mir-193b, mir-194, mir-194-1, mir-194-2, mir-195, mir-196, mir-196a-1, mir-196a-2, mir-196b, mir-199, mir-199a-1, mir-199a-2, mir-199b, mir-19a, mir-19b-1, mir-19b-2, mir-200a, mir-200b, mir-200c, mir-204, mir-204, mir-206, mir-208, mir-208, mir-208b, mir-20a, mir-20b, mir-211, mir-212, mir-215, mir-216, mir-216a, mir-216b, mir-218, mir-218-1, mir-218-2, mir-219, mir-219-1, mir-219-2, mir-220, mir-220, mir-220b, mir-221, mir-221, mir-222, mir-23, mir-23a, mir-23b, mir-24, mir-24-1, mir-24-2, mir-25, mir-25, mir-26, mir-26a-1, mir-26a-2, mir-26b, mir-27, mir-27a, mir-27b, mir-28, mir-28, mir-29, mir-290, mir-29a, mir-29b-1, mir-29b-2, mir-29c, mir-30, mir-300, mir-301a, mir-301b, mir-302, mir-302a, mir-302b, mir-302c, mir-302d, mir-30a, mir-30b, mir-30c-1, mir-30c-2, mir-30d, mir-30e, mir-323, mir-329, mir-329-1, mir-329-2, mir-33, mir-33a, mir-33b, mir-34, mir-34a, mir-34b, mir-34c, mir-365, mir-365-1, mir-365-2, mir-368, mir-369, mir-371, mir-372, mir-374, mir-374a, mir-374b, mir-376a-1, mir-376a-2, mir-376b, mir-376c, mir-377, mir-379, mir-379, mir-380, mir-381, mir-382, mir-409, mir-410, mir-411, mir-421, mir-429, mir-449, mir-449a, mir-449b, mir-450, mir-450a-1, mir-450a-2, mir-450b, mir-453, mir-487a, mir-487b, mir-494, mir-495, mir-496, mir-500, mir-500, mir-501, mir-502, mir-506, mir-506, mir-507, mir-508, mir-509, mir-509-1, mir-509-2, mir-509-3, mir-510, mir-511, mir-511-1, mir-511-2, mir-512, mir-512-1, mir-512-2, mir-513, mir-513-1, mir-513-2, mir-514-1, mir-514-2, mir-514-3, mir-515, mir-515-1, mir-515-2, mir-516a-1, mir-516a-2, mir-516b-1, mir-516b-2, mir-517a, mir-517b, mir-517c, mir-518a-1, mir-518a-2, mir-518b, mir-518c, mir-518d, mir-518e, mir-518f, mir-519a-1, mir-519a-2, mir-519b, mir-519c, mir-519d, mir-519e, mir-520a, mir-520b, mir-520c, mir-520d, mir-520e, mir-520f, mir-520g, mir-520h, mir-521-1, mir-521-2, mir-522, mir-523, mir-524, mir-525, mir-526a-1, mir-526a-2, mir-526b, mir-527, mir-532, mir-539, mir-543, mir-545, mir-548, mir-548a-1, mir-548a-2, mir-548a-3, mir-548b, mir-548c, mir-548d-1, mir-548d-2, mir-550, mir-550-1, mir-550-2, mir-551, mir-551a, mir-551b, mir-570, mir-579, mir-603, mir-655, mir-656, mir-660, mir-7, mir-7-1, mir-7-2, mir-7-3, mir-758, mir-8, mir-891, mir-891a, mir-891b, mir-892, mir-892a, mir-892b, mir-9, mir-9-1, mir-9-2, mir-92a-1, mir-92a-2, mir-92b, mir-93, mir-9-3, mir-941, mir-941-1, mir-941-2, mir-941-3, mir-941-4, mir-95, mir-95, mir-98, mir-99, mir-99a, mir-99b. Sequence, structural information, and functions of these and other miRNAs are well known to those of skill in the art and are described, for example, in the miRBase database, Release 16, September 2010, accessible at www.mirbase.org, and described in more detail in "miRBase: tools for microRNA genomics" by Griffiths-Jones S, Saini H K, van Dongen S, Enright A J, Nucleic Acids Res. 2008 36:D154-D158; "miRBase: microRNA sequences, targets and gene nomenclature" by Griffiths-Jones S, Grocock R J, van Dongen S, Bateman A, Enright A J, Nucleic Acids Res. 2006 34:D140-D144; and "The miRNA Registry" by Griffiths-Jones S, Nucleic Acids Res. 2004 32:D109-D111. The entire contents of miRBase, Release 16, September 2010, and the three references provided immediately above are incorporated herein in their entirety by reference for disclosure of miRNA sequences, structure, and function.

In some embodiments, the miRNA that is modulated using an agent or method provided herein is an miRNA that is implicated or known to be involved in the pathogenesis or the progression of a human disease, for example, in a cancer or neoplastic disease. miRNAs implicated or known to be involved in the pathogenesis or the progression of a human disease are well known to those of skill in the art and include, but are not limited to the miRNAs described in the Human mRNA & Disease Database (HMDD), Release January 2011, accessible at 202.38.126.151/hmdd/mirna/md/, and described in more detail in Lu M, Zhang Q, Deng M, Miao J, Guo Y, et al. (2008) An Analysis of Human MicroRNA and Disease Associations. PLoS ONE 3(10): e3420; the mir2disease base, Release March 2011, accessible at www.mir2disease.org, and described in more detail in Jiang Q., Wang Y., Hao Y., Juan L., Teng M., Zhang X., Li M., Wang G., Liu Y., (2009) miR2Disease: a manually curated database for microRNA deregulation in human disease. Nucleic Acids Res 37:D98-104; the entire contents of each database and reference are incorporated herein by reference.

In some embodiments, an miRNA modulating agent or method is provided that targets a particular miRNA or a particular miRNA cluster. For example, in some embodiments, the target miRNA is mir139 (e.g., miRBase accession: MI0000261). Mir139 has been described to act as a tumor suppressor and aberrant expression of mir139 has been reported to be associated with leukemia, for example, chronic lymphocytic leukemia, and with certain carcinomas, for example, adenocarcinoma, epithelial ovarian carcinoma, gastric carcinoma, and non-small cell lung carcinoma. In some embodiments, a miRNA modulating agent or method provided herein is useful for the alleviation of a disease or condition associated with aberrant mir139.

In some embodiments, the target miRNA is let-7 (e.g., miRBase accession: MI0000060-MI0000068). Let-7 has been reported to act as a tumor suppressor and aberrant expression of let-7 has been reported to be associated with tumorigenesis and tumor progression. In some embodiments, a let-7 mimic as provided herein is introduced into a neoplastic cell or tissue, for example, into a tumor cell or tumor tissue to alleviate tumor growth and/or any associated disease or condition. In some embodiments, introduction of a let-7 mimic into a tumor results in tumor regression.

In some embodiments, the target miRNA is mir-29 (e.g., miRBase accession: MI0000087, MI0000105, MI0000107). Aberrant expression of mir-29 has been reported to be associated with abnormal cell or tissue proliferation. For example, lack of miR-29a and/or miR-29b is implicated in progression of HCV infection, fibrosis or neuron remodeling and degeneration during Alzeheimer's disease. In some embodiments, introduction of a mir-29 mimic into an affected cell or tissue of a diseased subject is of therapeutic benefit in neurological disorders, liver and pulmonary fibrosis, HCV or other liver infection, cardiac hypertension and other indications with a reported involvement of mir-29. In some embodiments, introduction of a mir-29 mimic, as provided herein, for example, of a mir-29b mimic, can result in PDPN downregulation, which is involved in glioblastoma progression. In some embodiments, introduction of a mir-29 mimic as provided herein into a glioblastoma cell or tissue, for example, brain tissue of a glioblastoma patient, results in arrest or delay of tumor progression, tumor regression, or an alleviation of the disease state.

In some embodiments, the target miRNA is mir-133 (e.g., miRBase accession: MI0000450, MI0000451, MI0000822). Aberrant expression of miR-133 has been reported to be associated with CTGF downregulation as well as downregulation of molecular signaling pathways implicated in fibrosis. In some embodiments, a mir-133 mimic provided herein is used as an anti-fibrotic agent.

In some embodiments, the target miRNA is a miRNA of the mir-302-367 cluster, comprising mir-302a-mir302d and mir-367 (e.g., miRBase accession: MI0000738, MI0000772, MI0000773, MI0000775). Aberrant expression of the miRNA 302-367 cluster has been reported to be associated with inhibition of HDac2-regulated reprogramming of somatic cells into pluripotent stem cells. In some embodiments, introduction of a mimic of a miRNA in the miRNA 302-367 cluster into somatic stem cells supports or enhances the reprogramming of the somatic cells into pluripotent stem cells, which can be used for regenerative medicine approaches, and organ and tissue development.

In some embodiments, the target miRNA is mir-221 (e.g., miRBase accession: MI0000298). Mir-221 has been reported to act as a tumor suppressor, and aberrant expression of mir-221 has been reported to be associated with glioblastoma progression. In some embodiments, introduction, e.g., by direct injection or intrabrain infusion of a mir-221 mimic provided herein is used to treat or alleviate a symptom observed in glioblastoma patients.

In some embodiments, the target miRNA is mir-96 (e.g., miRBase accession: MI0000098). Mir-96 has been reported to be involved in hair growth regulation and aberrant expression of mir-96 has been reported to be associated with alopecia, for example, or chemotherapy-induced alopecia. In some embodiments, a mir-96 mimic as provided herein is used to treat alopecia.

In some embodiments, the target miRNA is mir-126, mir-335, or mir-206 (e.g., miRBase accession: MI0000471, MI0000816, MI0000490). These miRNAs are potent suppressors of tumor metastasis formation or maturation. For example, mir-126 has been reported to suppress endothelium cellular recruitment and, thus, metastasis maturation. In some embodiment, introduction of a mir-126, mir-335, or mir-206 mimic as provided herein into a primary tumor, or systemic administration to a subject having a tumor results in a partial or complete inhibition of metastasis formation.

In some embodiments, the target miRNA is a miRNA of the mir-17-92 cluster, comprising mir-17, mir-18a, mir-19a, mir-20a, mir-19b-1, and mir-92a-1 (e.g., miRBase accession: MI0000071, MI0000072, MI0000073, MI0000076, MI0000074, MI0000093). The mir-17-92 cluster has been reported to act as an oncogene and overexpression of the cluster, or of any member of the cluster has been reported to be associated with tumorigenesis. In some embodiments, a miRNA inhibitory agent targeting the mir-17-92 cluster as provided herein is administered to a tumor cell or tissue, or systemically, to a patient diagnosed with or suspected to have a tumor. Another pathway that uses small RNAs as sequence-specific regulators is the RNA interference (RNAi) pathway, which is an evolutionarily conserved response to the presence of double-stranded RNA (dsRNA) in the cell. The dsRNAs are cleaved into ~20-base pair (bp) duplexes of small-interfering RNAs (siRNAs) by Dicer. These small RNAs get assembled into multiprotein effector complexes called RNA-induced silencing complexes (RISCs). The siRNAs then guide the cleavage of target mRNAs with perfect complementarity.

Some aspects of biogenesis, protein complexes, and function are shared between the siRNA pathway and the miRNA pathway. The subject single-stranded polynucleotides may mimic the dsRNA in the siRNA mechanism, or the microRNA in the miRNA mechanism.

In certain embodiments, the modified RNAi constructs may have improved stability in serum and/or cerebral spinal fluid compared to an unmodified RNAi constructs having the same sequence.

In certain embodiments, the structure of the RNAi construct does not induce interferon response in primary cells, such as mammalian primary cells, including primary cells from human, mouse and other rodents, and other non-human mammals. In certain embodiments, the RNAi construct may also be used to inhibit expression of a target gene in an invertebrate organism.

To further increase the stability of the subject constructs in vivo, the 3'-end of the hairpin structure may be blocked by protective group(s). For example, protective groups such as inverted nucleotides, inverted abasic moieties, or amino-end modified nucleotides may be used. Inverted nucleotides may comprise an inverted deoxynucleotide. Inverted abasic moieties may comprise an inverted deoxyabasic moiety, such as a 3',3'-linked or 5',5'-linked deoxyabasic moiety.

The RNAi constructs of the invention are capable of inhibiting the synthesis of any target protein encoded by target gene(s). The invention includes methods to inhibit expression of a target gene either in a cell in vitro, or in vivo. As such, the RNAi constructs of the invention are useful for treating a patient with a disease characterized by the overexpression of a target gene.

The target gene can be endogenous or exogenous (e.g., introduced into a cell by a virus or using recombinant DNA technology) to a cell. Such methods may include introduction of RNA into a cell in an amount sufficient to inhibit expression of the target gene. By way of example, such an RNA molecule may have a guide strand that is complementary to the nucleotide sequence of the target gene, such that the composition inhibits expression of the target gene.

The invention also relates to vectors expressing the nucleic acids of the invention, and cells comprising such vectors or the nucleic acids. The cell may be a mammalian cell in vivo or in culture, such as a human cell.

The invention further relates to compositions comprising the subject RNAi constructs, and a pharmaceutically acceptable carrier or diluent.

Another aspect of the invention provides a method for inhibiting the expression of a target gene in a mammalian cell, comprising contacting the mammalian cell with any of the subject RNAi constructs.

The method may be carried out in vitro, ex vivo, or in vivo, in, for example, mammalian cells in culture, such as a human cell in culture.

The target cells (e.g., mammalian cell) may be contacted in the presence of a delivery reagent, such as a lipid (e.g., a cationic lipid) or a liposome.

Another aspect of the invention provides a method for inhibiting the expression of a target gene in a mammalian cell, comprising contacting the mammalian cell with a vector expressing the subject RNAi constructs.

In one aspect of the invention, a longer duplex polynucleotide is provided, including a first polynucleotide that ranges in size from about 16 to about 30 nucleotides; a second polynucleotide that ranges in size from about 26 to about 46 nucleotides, wherein the first polynucleotide (the antisense strand) is complementary to both the second polynucleotide (the sense strand) and a target gene, and wherein both polynucleotides form a duplex and wherein the first polynucleotide contains a single stranded region longer than 6 bases in length and is modified with alternative chemical modification pattern, and/or includes a conjugate moiety that facilitates cellular delivery. In this embodiment, between about 40% to about 90% of the nucleotides of the passenger strand between about 40% to about 90% of the nucleotides of the guide strand, and between about 40% to about 90% of the nucleotides of the single stranded region of the first polynucleotide are chemically modified nucleotides.

In an embodiment, the chemically modified nucleotide in the polynucleotide duplex may be any chemically modified nucleotide known in the art, such as those discussed in detail above. In a particular embodiment, the chemically modified nucleotide is selected from the group consisting of 2' F modified nucleotides, 2'-O-methyl modified and 2' deoxy nucleotides. In another particular embodiment, the chemically modified nucleotides results from "hydrophobic modifications" of the nucleotide base. In another particular embodiment, the chemically modified nucleotides are phosphorothioates. In an additional particular embodiment, chemically modified nucleotides are combination of phosphorothioates, 2'-O-methyl, 2' deoxy, hydrophobic modifications and phosphorothioates. As these groups of modifications refer to modification of the ribose ring, back bone and nucleotide, it is feasible that some modified nucleotides will carry a combination of all three modification types.

In another embodiment, the chemical modification is not the same across the various regions of the duplex. In a particular embodiment, the first polynucleotide (the passenger strand), has a large number of diverse chemical modifications in various positions. For this polynucleotide up to 90% of nucleotides might be chemically modified and/or have mismatches introduced.

In another embodiment, chemical modifications of the first or second polynucleotide include, but not limited to, 5' position modification of Uridine and Cytosine (4-pyridyl, 2-pyridyl, indolyl, phenyl ($C_6H_5OH$); tryptophanyl (C8H6N)CH2CH(NH2)CO), isobutyl, butyl, aminobenzyl; phenyl; naphthyl, etc), where the chemical modification might alter base pairing capabilities of a nucleotide. For the guide strand an important feature of this aspect of the invention is the position of the chemical modification relative to the 5' end of the antisense and sequence. For example, chemical phosphorylation of the 5' end of the guide strand is usually beneficial for efficacy. O-methyl modifications in the seed region of the sense strand (position 2-7 relative to the 5' end) are not generally well tolerated, whereas 2'F and deoxy are well tolerated. The mid part of the guide strand and the 3' end of the guide strand are more permissive in a type of chemical modifications applied. Deoxy modifications are not tolerated at the 3' end of the guide strand.

A unique feature of this aspect of the invention involves the use of hydrophobic modification on the bases. In one embodiment, the hydrophobic modifications are preferably positioned near the 5' end of the guide strand, in other embodiments, they localized in the middle of the guides strand, in other embodiment they localized at the 3' end of the guide strand and yet in another embodiment they are distributed thought the whole length of the polynucleotide. The same type of patterns is applicable to the passenger strand of the duplex.

The other part of the molecule is a single stranded region. The single stranded region is expected to range from 7 to 40 nucleotides.

In one embodiment, the single stranded region of the first polynucleotide contains modifications selected from the group consisting of between 40% and 90% hydrophobic base modifications, between 40%-90% phosphorothioates, between 40%-90% modification of the ribose moiety, and any combination of the preceding.

Efficiency of guide strand (first polynucleotide) loading into the RISC complex might be altered for heavily modified polynucleotides, so in one embodiment, the duplex polynucleotide includes a mismatch between nucleotide 9, 11, 12, 13, or 14 on the guide strand (first polynucleotide) and the opposite nucleotide on the sense strand (second polynucleotide) to promote efficient guide strand loading.

More detailed aspects of the invention are described in the sections below.

Duplex Characteristics

Double-stranded oligonucleotides of the invention may be formed by two separate complementary nucleic acid strands. Duplex formation can occur either inside or outside the cell containing the target gene.

As used herein, the term "duplex" includes the region of the double-stranded nucleic acid molecule(s) that is (are) hydrogen bonded to a complementary sequence. Double-stranded oligonucleotides of the invention may comprise a nucleotide sequence that is sense to a target gene and a complementary sequence that is antisense to the target gene. The sense and antisense nucleotide sequences correspond to the target gene sequence, e.g., are identical or are sufficiently identical to effect target gene inhibition (e.g., are about at least about 98% identical, 96% identical, 94%, 90% identical, 85% identical, or 80% identical) to the target gene sequence.

In certain embodiments, the double-stranded oligonucleotide of the invention is double-stranded over its entire length, i.e., with no overhanging single-stranded sequence at either end of the molecule, i.e., is blunt-ended. In other embodiments, the individual nucleic acid molecules can be of different lengths. In other words, a double-stranded oligonucleotide of the invention is not double-stranded over its entire length. For instance, when two separate nucleic acid molecules are used, one of the molecules, e.g., the first molecule comprising an antisense sequence, can be longer than the second molecule hybridizing thereto (leaving a portion of the molecule single-stranded). Likewise, when a single nucleic acid molecule is used a portion of the molecule at either end can remain single-stranded.

In one embodiment, a double-stranded oligonucleotide of the invention contains mismatches and/or loops or bulges, but is double-stranded over at least about 70% of the length of the oligonucleotide. In another embodiment, a double-stranded oligonucleotide of the invention is double-stranded over at least about 80% of the length of the oligonucleotide. In another embodiment, a double-stranded oligonucleotide of the invention is double-stranded over at least about 90%-95% of the length of the oligonucleotide. In another embodiment, a double-stranded oligonucleotide of the invention is double-stranded over at least about 96%-98% of the length of the oligonucleotide. In certain embodiments, the double-stranded oligonucleotide of the invention contains at least or up to 1, 2, 3, 4, 5, 6, 7, 8, 9, 10, 11, 12, 13, 14, or 15 mismatches.

Modifications

The nucleotides of the invention may be modified at various locations, including the sugar moiety, the phosphodiester linkage, and/or the base.

Sugar moieties include natural, unmodified sugars, e.g., monosaccharide (such as pentose, e.g., ribose, deoxyribose), modified sugars and sugar analogs. In general, possible modifications of nucleomonomers, particularly of a sugar moiety, include, for example, replacement of one or more of the hydroxyl groups with a halogen, a heteroatom, an aliphatic group, or the functionalization of the hydroxyl group as an ether, an amine, a thiol, or the like.

One particularly useful group of modified nucleomonomers are 2'-O-methyl nucleotides. Such 2'-O-methyl nucleotides may be referred to as "methylated," and the corresponding nucleotides may be made from unmethylated nucleotides followed by alkylation or directly from methylated nucleotide reagents. Modified nucleomonomers may be used in combination with unmodified nucleomonomers. For example, an oligonucleotide of the invention may contain both methylated and unmethylated nucleomonomers.

Some exemplary modified nucleomonomers include sugar- or backbone-modified ribonucleotides. Modified ribonucleotides may contain a non-naturally occurring base (instead of a naturally occurring base), such as uridines or cytidines modified at the 5'-position, e.g., 5'-(2-amino)propyl uridine and 5'-bromo uridine; adenosines and guanosines modified at the 8-position, e.g., 8-bromo guanosine; deaza nucleotides, e.g., 7-deaza-adenosine; and N-alkylated nucleotides, e.g., N6-methyl adenosine. Also, sugar-modified ribonucleotides may have the 2'-OH group replaced by a H, alxoxy (or OR), R or alkyl, halogen, SH, SR, amino (such as $NH_2$, NHR, $NR_2$), or CN group, wherein R is lower alkyl, alkenyl, or alkynyl.

Modified ribonucleotides may also have the phosphodiester group connecting to adjacent ribonucleotides replaced by a modified group, e.g., of phosphorothioate group. More generally, the various nucleotide modifications may be combined.

Although the antisense (guide) strand may be substantially identical to at least a portion of the target gene (or genes), at least with respect to the base pairing properties, the sequence need not be perfectly identical to be useful, e.g., to inhibit expression of a target gene's phenotype. Generally, higher homology can be used to compensate for the use of a shorter antisense gene. In some cases, the antisense strand generally will be substantially identical (although in antisense orientation) to the target gene.

The use of 2'-O-methyl modified RNA may also be beneficial in circumstances in which it is desirable to minimize cellular stress responses. RNA having 2'-O-methyl nucleomonomers may not be recognized by cellular machinery that is thought to recognize unmodified RNA. The use of 2'-O-methylated or partially 2'-O-methylated RNA may avoid the interferon response to double-stranded nucleic acids, while maintaining target RNA inhibition. This may be useful, for example, for avoiding the interferon or other cellular stress responses, both in short RNAi (e.g., siRNA) sequences that induce the interferon response, and in longer RNAi sequences that may induce the interferon response.

Overall, modified sugars may include D-ribose, 2'-O-alkyl (including 2'-O-methyl and 2'-O-ethyl), i.e., 2'-alkoxy, 2'-amino, 2'-S-alkyl, 2'-halo (including 2'-fluoro), 2'-methoxyethoxy, 2'-allyloxy ($-OCH_2CH=CH_2$), 2'-propargyl, 2'-propyl, ethynyl, ethenyl, propenyl, and cyano and the like. In one embodiment, the sugar moiety can be a hexose and incorporated into an oligonucleotide as described (Augustyns, K., et al., *Nucl. Acids. Res.* 18:4711 (1992)). Exemplary nucleomonomers can be found, e.g., in U.S. Pat. No. 5,849,902, incorporated by reference herein.

The term "alkyl" includes saturated aliphatic groups, including straight-chain alkyl groups (e.g., methyl, ethyl, propyl, butyl, pentyl, hexyl, heptyl, octyl, nonyl, decyl, etc.), branched-chain alkyl groups (isopropyl, tert-butyl, isobutyl, etc.), cycloalkyl (alicyclic) groups (cyclopropyl, cyclopentyl, cyclohexyl, cycloheptyl, cyclooctyl), alkyl substituted cycloalkyl groups, and cycloalkyl substituted alkyl groups. In certain embodiments, a straight chain or branched chain alkyl has 6 or fewer carbon atoms in its backbone (e.g., $C_1$-$C_6$ for straight chain, $C_3$-$C_6$ for branched chain), and more preferably 4 or fewer. Likewise, preferred cycloalkyls have from 3-8 carbon atoms in their ring structure, and more preferably have 5 or 6 carbons in the ring structure. The term $C_1$-$C_6$ includes alkyl groups containing 1 to 6 carbon atoms.

Moreover, unless otherwise specified, the term alkyl includes both "unsubstituted alkyls" and "substituted alkyls," the latter of which refers to alkyl moieties having independently selected substituents replacing a hydrogen on one or more carbons of the hydrocarbon backbone. Such substituents can include, for example, alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety. Cycloalkyls can be further substituted, e.g., with the substituents described above. An "alkylaryl" or an "arylalkyl" moiety is an alkyl substituted with an aryl (e.g., phenylmethyl (benzyl)). The term "alkyl" also includes the side chains of natural and unnatural amino acids. The term "n-alkyl" means a straight chain (i.e., unbranched) unsubstituted alkyl group.

The term "alkenyl" includes unsaturated aliphatic groups analogous in length and possible substitution to the alkyls described above, but that contain at least one double bond. For example, the term "alkenyl" includes straight-chain alkenyl groups (e.g., ethylenyl, propenyl, butenyl, pentenyl, hexenyl, heptenyl, octenyl, nonenyl, decenyl, etc.), branched-chain alkenyl groups, cycloalkenyl (alicyclic) groups (cyclopropenyl, cyclopentenyl, cyclohexenyl, cycloheptenyl, cyclooctenyl), alkyl or alkenyl substituted cycloalkenyl groups, and cycloalkyl or cycloalkenyl substituted alkenyl groups. In certain embodiments, a straight chain or branched chain alkenyl group has 6 or fewer carbon atoms in its backbone (e.g., $C_2$-$C_6$ for straight chain, $C_3$-$C_6$ for branched chain). Likewise, cycloalkenyl groups may have from 3-8 carbon atoms in their ring structure, and more preferably have 5 or 6 carbons in the ring structure. The term $C_2$-$C_6$ includes alkenyl groups containing 2 to 6 carbon atoms.

Moreover, unless otherwise specified, the term alkenyl includes both "unsubstituted alkenyls" and "substituted alkenyls," the latter of which refers to alkenyl moieties having independently selected substituents replacing a hydrogen on one or more carbons of the hydrocarbon backbone. Such substituents can include, for example, alkyl groups, alkynyl groups, halogens, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety.

The term "alkynyl" includes unsaturated aliphatic groups analogous in length and possible substitution to the alkyls described above, but which contain at least one triple bond. For example, the term "alkynyl" includes straight-chain alkynyl groups (e.g., ethynyl, propynyl, butynyl, pentynyl, hexynyl, heptynyl, octynyl, nonynyl, decynyl, etc.), branched-chain alkynyl groups, and cycloalkyl or cycloalkenyl substituted alkynyl groups. In certain embodiments, a straight chain or branched chain alkynyl group has 6 or fewer carbon atoms in its backbone (e.g., $C_2$-$C_6$ for straight chain, $C_3$-$C_6$ for branched chain). The term $C_2$-$C_6$ includes alkynyl groups containing 2 to 6 carbon atoms.

Moreover, unless otherwise specified, the term alkynyl includes both "unsubstituted alkynyls" and "substituted alkynyls," the latter of which refers to alkynyl moieties having independently selected substituents replacing a hydrogen on one or more carbons of the hydrocarbon backbone. Such substituents can include, for example, alkyl groups, alkynyl groups, halogens, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety.

Unless the number of carbons is otherwise specified, "lower alkyl" as used herein means an alkyl group, as defined above, but having from one to five carbon atoms in its backbone structure. "Lower alkenyl" and "lower alkynyl" have chain lengths of, for example, 2-5 carbon atoms.

The term "alkoxy" includes substituted and unsubstituted alkyl, alkenyl, and alkynyl groups covalently linked to an oxygen atom. Examples of alkoxy groups include methoxy, ethoxy, isopropyloxy, propoxy, butoxy, and pentoxy groups. Examples of substituted alkoxy groups include halogenated alkoxy groups. The alkoxy groups can be substituted with independently selected groups such as alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moieties. Examples of halogen substituted alkoxy groups include, but are not limited to, fluoromethoxy, difluoromethoxy, trifluoromethoxy, chloromethoxy, dichloromethoxy, trichloromethoxy, etc.

The term "heteroatom" includes atoms of any element other than carbon or hydrogen. Preferred heteroatoms are nitrogen, oxygen, sulfur and phosphorus.

The term "hydroxy" or "hydroxyl" includes groups with an —OH or —O⁻ (with an appropriate counterion).

The term "halogen" includes fluorine, bromine, chlorine, iodine, etc. The term "perhalogenated" generally refers to a moiety wherein all hydrogens are replaced by halogen atoms.

The term "substituted" includes independently selected substituents which can be placed on the moiety and which allow the molecule to perform its intended function. Examples of substituents include alkyl, alkenyl, alkynyl, aryl, $(CR'R'')_{0-3}NR'R''$, $(CR'R'')_{0-3}CN$, $NO_2$, halogen, $(CR'R'')_{0-3}C(halogen)_3$, $(CR'R'')_{0-3}CH(halogen)_2$, $(CR'R'')_{0-3}CH_2(halogen)$, $(CR'R'')_{0-3}CONR'R''$, $(CR'R'')_{0-3}S(O)_{1-2}NR'R''$, $(CR'R'')_{0-3}CHO$, $(CR'R'')_{0-3}O(CR'R'')_{0-3}H$, $(CR'R'')_{0-3}S(O)_{0-2}R'$, $(CR'R'')_{0-3}O(CR'R'')_{0-3}H$, $(CR'R'')_{0-3}COR'$, $(CR'R'')_{0-3}CO_2R'$, or $(CR'R'')_{0-3}OR'$ groups; wherein each R' and R" are each independently hydrogen, a $C_1$-$C_5$ alkyl, $C_2$-$C_5$ alkenyl, $C_2$-$C_5$ alkynyl, or aryl group, or R' and R" taken together are a benzylidene group or a —$(CH_2)_2O(CH_2)_2$— group.

The term "amine" or "amino" includes compounds or moieties in which a nitrogen atom is covalently bonded to at least one carbon or heteroatom. The term "alkyl amino" includes groups and compounds wherein the nitrogen is bound to at least one additional alkyl group. The term "dialkyl amino" includes groups wherein the nitrogen atom is bound to at least two additional alkyl groups.

The term "ether" includes compounds or moieties which contain an oxygen bonded to two different carbon atoms or heteroatoms. For example, the term includes "alkoxyalkyl," which refers to an alkyl, alkenyl, or alkynyl group covalently bonded to an oxygen atom which is covalently bonded to another alkyl group.

The term "base" includes the known purine and pyrimidine heterocyclic bases, deazapurines, and analogs (including heterocyclic substituted analogs, e.g., aminoethyoxy phenoxazine), derivatives (e.g., 1-alkyl-, 1-alkenyl-, heteroaromatic- and 1-alkynyl derivatives) and tautomers thereof. Examples of purines include adenine, guanine, inosine, diaminopurine, and xanthine and analogs (e.g., 8-oxo-$N^6$-methyladenine or 7-diazaxanthine) and derivatives thereof. Pyrimidines include, for example, thymine, uracil, and cytosine, and their analogs (e.g., 5-methylcytosine, 5-methyluracil, 5-(1-propynyl)uracil, 5-(1-propynyl) cytosine and 4,4-ethanocytosine). Other examples of suitable bases include non-purinyl and non-pyrimidinyl bases such as 2-aminopyridine and triazines.

In a preferred embodiment, the nucleomonomers of an oligonucleotide of the invention are RNA nucleotides. In another preferred embodiment, the nucleomonomers of an oligonucleotide of the invention are modified RNA nucleotides. Thus, the oligonucleotides contain modified RNA nucleotides.

The term "nucleoside" includes bases which are covalently attached to a sugar moiety, preferably ribose or deoxyribose. Examples of preferred nucleosides include ribonucleosides and deoxyribonucleosides. Nucleosides also include bases linked to amino acids or amino acid analogs which may comprise free carboxyl groups, free amino groups, or protecting groups. Suitable protecting groups are well known in the art (see P. G. M. Wuts and T. W. Greene, "Protective Groups in Organic Synthesis", $2^{nd}$ Ed., Wiley-Interscience, New York, 1999).

The term "nucleotide" includes nucleosides which further comprise a phosphate group or a phosphate analog.

As used herein, the term "linkage" includes a naturally occurring, unmodified phosphodiester moiety (—O—($PO^{2-}$)—O—) that covalently couples adjacent nucleomonomers. As used herein, the term "substitute linkage" includes any analog or derivative of the native phosphodiester group that covalently couples adjacent nucleomonomers. Substitute linkages include phosphodiester analogs, e.g., phosphorothioate, phosphorodithioate, and P-ethyoxyphosphodiester, P-ethoxyphosphodiester, P-alkyloxyphosphotriester, methylphosphonate, and nonphosphorus containing linkages, e.g., acetals and amides. Such substitute linkages are known in the art (e.g., Bjergarde et al. 1991. Nucleic Acids Res. 19:5843; Caruthers et al. 1991. Nucleosides Nucleotides. 10:47). In certain embodiments, non-hydrolizable linkages are preferred, such as phosphorothiate linkages.

In certain embodiments, oligonucleotides of the invention comprise hydrophobically modified nucleotides or "hydrophobic modifications." As used herein "hydrophobic modifications" refers to bases that are modified such that (1) overall hydrophobicity of the base is significantly increased, and/or (2) the base is still capable of forming close to regular Watson-Crick interaction. Several non-limiting examples of base modifications include 5-position uridine and cytidine modifications such as methyl, ethyl, phenyl, 4-pyridyl, 2-pyridyl, indolyl, and isobutyl, phenyl (C6H5OH); tryptophanyl (C8H6N)CH2CH(NH2)CO), butyl, aminobenzyl; and naphthyl.

In certain embodiments, oligonucleotides of the invention comprise 3' and 5' termini (except for circular oligonucleotides). In one embodiment, the 3' and 5' termini of an oligonucleotide can be substantially protected from nucleases e.g., by modifying the 3' or 5' linkages (e.g., U.S. Pat. No. 5,849,902 and WO 98/13526). For example, oligonucleotides can be made resistant by the inclusion of a "blocking group." The term "blocking group" as used herein refers to substituents (e.g., other than OH groups) that can be attached to oligonucleotides or nucleomonomers, either as protecting groups or coupling groups for synthesis (e.g., FITC, propyl ($CH_2$—$CH_2$—$CH_3$), glycol (—O—$CH_2$—$CH_2$—O—) phosphate ($PO_3^{2-}$), hydrogen phosphonate, or phosphoramidite). "Blocking groups" also include "end blocking groups" or "exonuclease blocking groups" which protect the 5' and 3' termini of the oligonucleotide, including modified nucleotides and non-nucleotide exonuclease resistant structures.

Exemplary end-blocking groups include cap structures (e.g., a 7-methylguanosine cap), inverted nucleomonomers, e.g., with 3'-3' or 5'-5' end inversions (see, e.g., Ortiagao et al. 1992. *Antisense Res. Dev.* 2:129), methylphosphonate, phosphoramidite, non-nucleotide groups (e.g., non-nucleotide linkers, amino linkers, conjugates) and the like. The 3' terminal nucleomonomer can comprise a modified sugar moiety. The 3' terminal nucleomonomer comprises a 3'-O that can optionally be substituted by a blocking group that prevents 3'-exonuclease degradation of the oligonucleotide. For example, the 3'-hydroxyl can be esterified to a nucleotide through a 3'→3' internucleotide linkage. For example, the alkyloxy radical can be methoxy, ethoxy, or isopropoxy, and preferably, ethoxy. Optionally, the 3'→3'linked nucleotide at the 3' terminus can be linked by a substitute linkage. To reduce nuclease degradation, the 5' most 3'→5' linkage can be a modified linkage, e.g., a phosphorothioate or a P-alkyloxyphosphotriester linkage. Preferably, the two 5' most 3'→5' linkages are modified linkages. Optionally, the 5' terminal hydroxy moiety can be esterified with a phosphorus containing moiety, e.g., phosphate, phosphorothioate, or P-ethoxyphosphate.

Another type of conjugates that can be attached to the end (3' or 5' end), the loop region, or any other parts of the miniRNA might include a sterol, sterol type molecule, peptide, small molecule, protein, etc. In some embodiments, a miniRNA may contain more than one conjugates (same or different chemical nature). In some embodiments, the conjugate is cholesterol.

Another way to increase target gene specificity, or to reduce off-target silencing effect, is to introduce a 2'-modification (such as the 2'-O methyl modification) at a position corresponding to the second 5'-end nucleotide of the guide sequence. This allows the positioning of this 2'-modification in the Dicer-resistant hairpin structure, thus enabling one to design better RNAi constructs with less or no off-target silencing.

In one embodiment, a hairpin polynucleotide of the invention can comprise one nucleic acid portion which is DNA and one nucleic acid portion which is RNA. Antisense (guide) sequences of the invention can be "chimeric oligonucleotides" which comprise an RNA-like and a DNA-like region.

The language "RNase H activating region" includes a region of an oligonucleotide, e.g., a chimeric oligonucleotide, that is capable of recruiting RNase H to cleave the target RNA strand to which the oligonucleotide binds. Typically, the RNase activating region contains a minimal core (of at least about 3-5, typically between about 3-12, more typically, between about 5-12, and more preferably between about 5-10 contiguous nucleomonomers) of DNA or DNA-like nucleomonomers. (See, e.g., U.S. Pat. No. 5,849,902). Preferably, the RNase H activating region comprises about nine contiguous deoxyribose containing nucleomonomers.

The language "non-activating region" includes a region of an antisense sequence, e.g., a chimeric oligonucleotide, that does not recruit or activate RNase H. Preferably, a non-activating region does not comprise phosphorothioate DNA. The oligonucleotides of the invention comprise at least one non-activating region. In one embodiment, the non-activating region can be stabilized against nucleases or can provide specificity for the target by being complementary to the target and forming hydrogen bonds with the target nucleic acid molecule, which is to be bound by the oligonucleotide.

In one embodiment, at least a portion of the contiguous polynucleotides are linked by a substitute linkage, e.g., a phosphorothioate linkage.

In certain embodiments, most or all of the nucleotides beyond the guide sequence (2'-modified or not) are linked by phosphorothioate linkages. Such constructs tend to have improved pharmacokinetics due to their higher affinity for serum proteins. The phosphorothioate linkages in the non-guide sequence portion of the polynucleotide generally do not interfere with guide strand activity, once the latter is loaded into RISC.

Antisense (guide) sequences of the present invention may include "morpholino oligonucleotides." Morpholino oligonucleotides are non-ionic and function by an RNase H-independent mechanism. Each of the 4 genetic bases (Adenine, Cytosine, Guanine, and Thymine/Uracil) of the morpholino oligonucleotides is linked to a 6-membered morpholine ring. Morpholino oligonucleotides are made by joining the 4 different subunit types by, e.g., non-ionic phosphorodiamidate inter-subunit linkages. Morpholino oligonucleotides have many advantages including: complete resistance to nucleases (Antisense & Nucl. Acid Drug Dev. 1996. 6:267); predictable targeting (Biochemica Biophysica Acta. 1999. 1489:141); reliable activity in cells (Antisense & Nucl. Acid Drug Dev. 1997. 7:63); excellent sequence specificity (Antisense & Nucl. Acid Drug Dev. 1997. 7:151); minimal non-antisense activity (Biochemica Biophysica Acta. 1999. 1489:141); and simple osmotic or scrape delivery (Antisense & Nucl. Acid Drug Dev. 1997. 7:291). Morpholino oligonucleotides are also preferred because of their non-toxicity at high doses. A discussion of the preparation of morpholino oligonucleotides can be found in Antisense & Nucl. Acid Drug Dev. 1997. 7:187.

The chemical modifications described herein are believed, based on the data described herein, to promote single stranded polynucleotide loading into the RISC. Single stranded polynucleotides have been shown to be active in loading into RISC and inducing gene silencing. However, the level of activity for single stranded polynucleotides appears to be 2 to 4 orders of magnitude lower when compared to a duplex polynucleotide.

Figure 5:
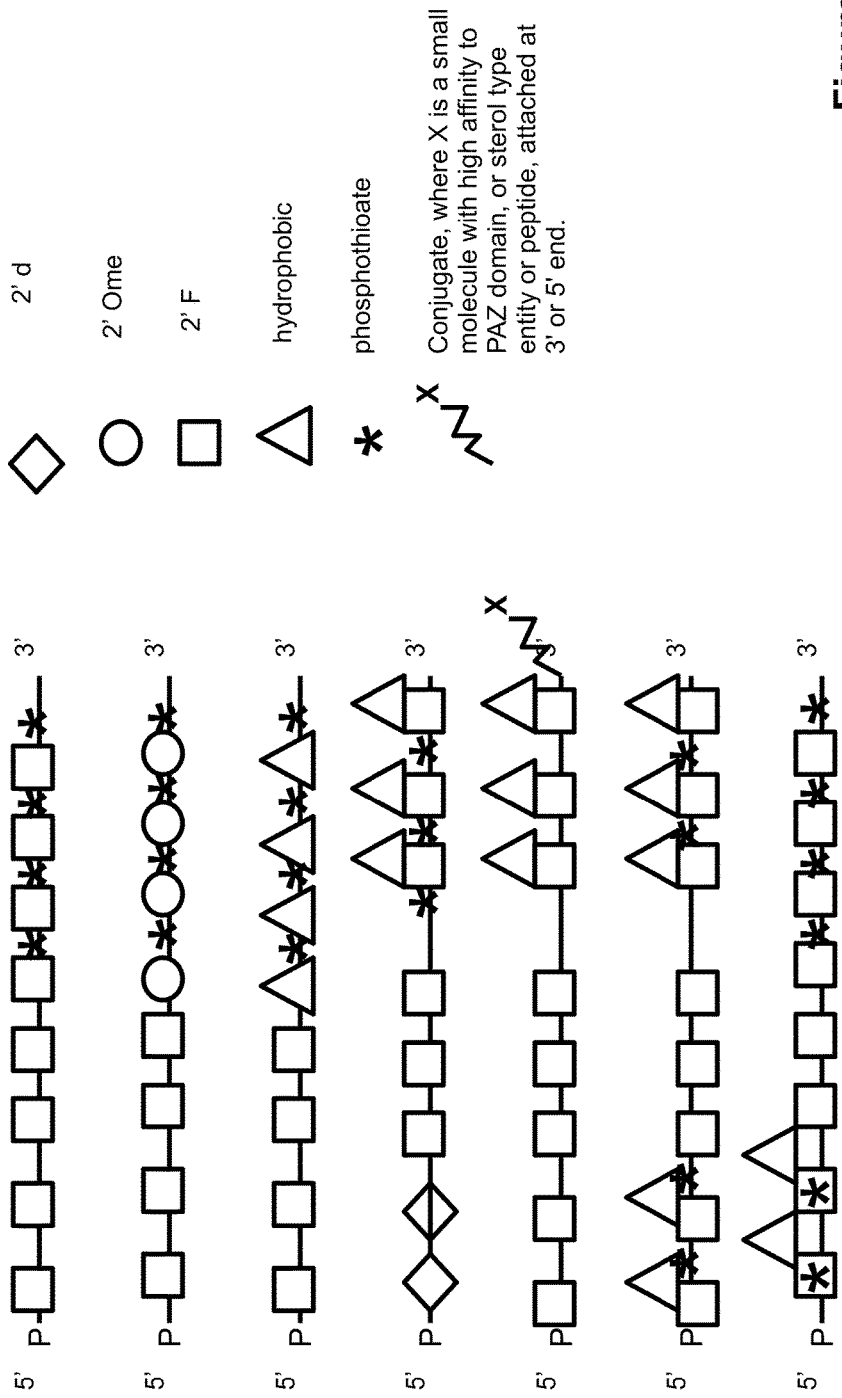
FIG. 5 is a schematic depicting examples of structural and chemical compositions of single stranded RISC entering polynucleotides. The combination of one or more modifications including 2'd, 2'Ome, 2'F, hydrophobic and phosphorothioate modifications can be used to optimize single strand entry into the RISC.

The present invention provides a description of the chemical modification patterns, which may (a) significantly increase stability of the single stranded polynucleotide (b) promote efficient loading of the polynucleotide into the RISC complex and (c) improve uptake of the single stranded nucleotide by the cell. FIG. 5 provides some non-limiting examples of the chemical modification patterns which may be beneficial for achieving single stranded polynucleotide efficacy inside the cell. The chemical modification patterns may include combination of ribose, backbone, hydrophobic nucleoside and conjugate type of modifications. In addition, in some of the embodiments, the 5' end of the single polynucleotide may be chemically phosphorylated.

Figure 6:
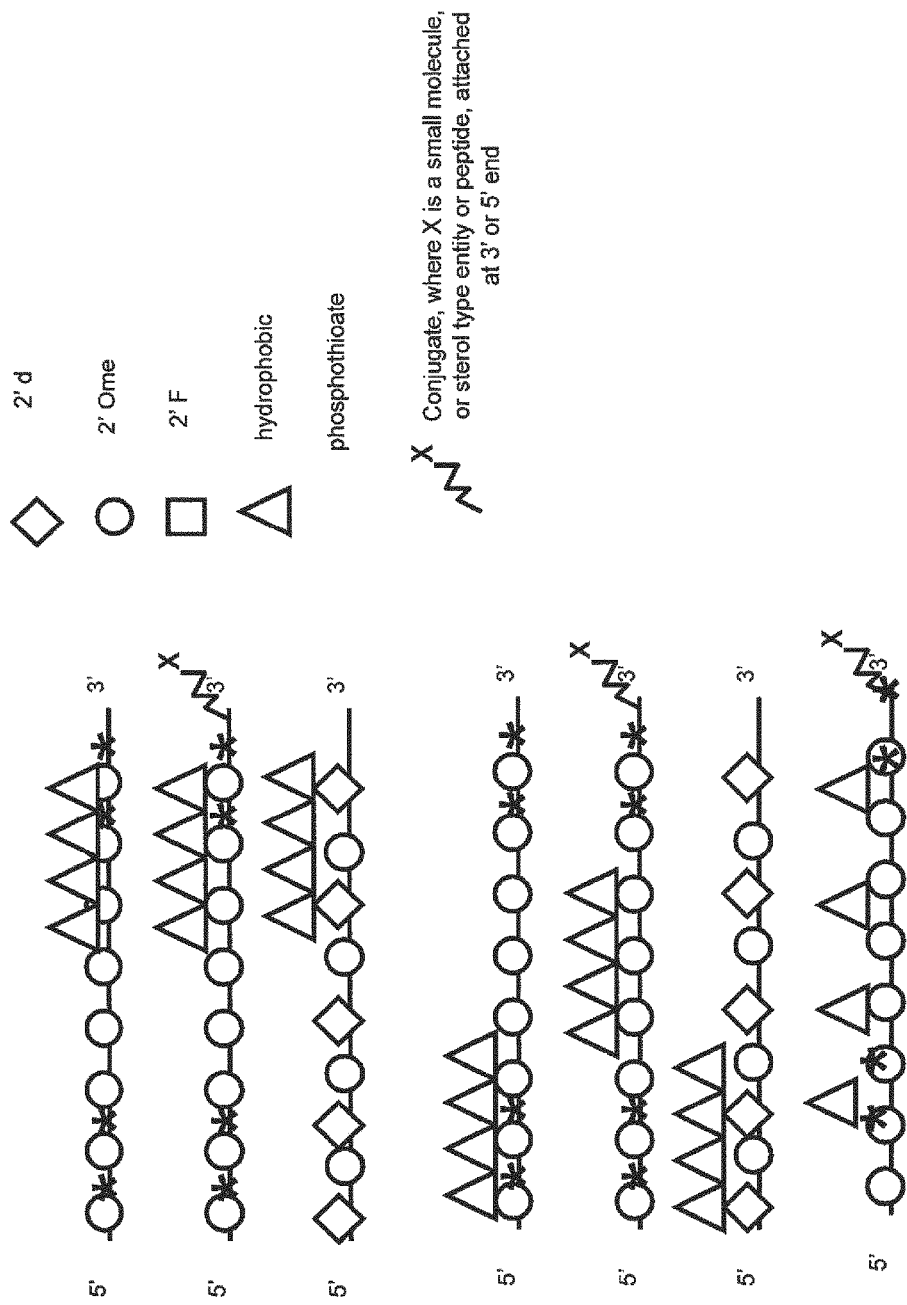
FIG. 6 is a schematic depicting examples of structural and chemical composition of RISC substrate inhibitors. Combinations of one or more chemical modifications can be used to mediate efficient uptake and efficient binding to preloaded RISC complex.

In yet another embodiment, the present invention provides a description of the chemical modifications patterns, which improve functionality of RISC inhibiting polynucleotides. Single stranded polynucleotides have been shown to inhibit activity of a preloaded RISC complex through the substrate competition mechanism. For these types of molecules, conventionally called antagomers, the activity usually requires high concentration and in vivo delivery is not very effective. The present invention provides a description of the chemical modification patterns, which may (a) significantly increase stability of the single stranded polynucleotide (b) promote efficient recognition of the polynucleotide by the RISC as a substrate and/or (c) improve uptake of the single stranded nucleotide by the cell. FIG. 6 provides some non-limiting examples of the chemical modification patterns that may be beneficial for achieving single stranded polynucleotide efficacy inside the cell. The chemical modification patterns may include combination of ribose, backbone, hydrophobic nucleoside and conjugate type of modifications.

The modifications provided by the present invention are applicable to all polynucleotides. This includes single stranded RISC entering polynucleotides, single stranded RISC inhibiting polynucleotides, conventional duplexed polynucleotides of variable length (15-40 bp), asymmetric duplexed polynucleotides, and the like. Polynucleotides may be modified with wide variety of chemical modification patterns, including 5' end, ribose, backbone and hydrophobic nucleoside modifications.

Synthesis

Oligonucleotides of the invention can be synthesized by any method known in the art, e.g., using enzymatic synthesis and/or chemical synthesis. The oligonucleotides can be synthesized in vitro (e.g., using enzymatic synthesis and chemical synthesis) or in vivo (using recombinant DNA technology well known in the art).

In a preferred embodiment, chemical synthesis is used for modified polynucleotides. Chemical synthesis of linear oligonucleotides is well known in the art and can be achieved by solution or solid phase techniques. Preferably, synthesis is by solid phase methods. Oligonucleotides can be made by any of several different synthetic procedures including the phosphoramidite, phosphite triester, H-phosphonate, and phosphotriester methods, typically by automated synthesis methods.

Oligonucleotide synthesis protocols are well known in the art and can be found, e.g., in U.S. Pat. No. 5,830,653; WO 98/13526; Stec et al. 1984. *J. Am. Chem. Soc.* 106:6077; Stec et al. 1985. *J. Org. Chem.* 50:3908; Stec et al. J. Chromatog. 1985. 326:263; LaPlanche et al. 1986. *Nucl. Acid. Res.* 1986. 14:9081; Fasman G. D., 1989. Practical Handbook of Biochemistry and Molecular Biology. 1989. CRC Press, Boca Raton, Fla.; Lamone. 1993. *Biochem. Soc. Trans.* 21:1; U.S. Pat. No. 5,013,830; U.S. Pat. No. 5,214,135; U.S. Pat. No. 5,525,719; Kawasaki et al. 1993. *J. Med. Chem.* 36:831; WO 92/03568; U.S. Pat. No. 5,276,019; and U.S. Pat. No. 5,264,423.

The synthesis method selected can depend on the length of the desired oligonucleotide and such choice is within the skill of the ordinary artisan. For example, the phosphoramidite and phosphite triester method can produce oligonucleotides having 175 or more nucleotides, while the H-phosphonate method works well for oligonucleotides of less than 100 nucleotides. If modified bases are incorporated into the oligonucleotide, and particularly if modified phosphodiester linkages are used, then the synthetic procedures are altered as needed according to known procedures. In this regard, Uhlmann et al. (1990, *Chemical Reviews* 90:543-584) provide references and outline procedures for making oligonucleotides with modified bases and modified phosphodiester linkages. Other exemplary methods for making oligonucleotides are taught in Sonveaux. 1994. "Protecting Groups in Oligonucleotide Synthesis"; Agrawal. *Methods in Molecular Biology* 26:1. Exemplary synthesis methods are also taught in "Oligonucleotide Synthesis—A Practical Approach" (Gait, M. J. IRL Press at Oxford University Press. 1984). Moreover, linear oligonucleotides of defined sequence, including some sequences with modified nucleotides, are readily available from several commercial sources.

The oligonucleotides may be purified by polyacrylamide gel electrophoresis, or by any of a number of chromatographic methods, including gel chromatography and high pressure liquid chromatography. To confirm a nucleotide sequence, especially unmodified nucleotide sequences, oligonucleotides may be subjected to DNA sequencing by any of the known procedures, including Maxam and Gilbert sequencing, Sanger sequencing, capillary electrophoresis sequencing, the wandering spot sequencing procedure or by using selective chemical degradation of oligonucleotides bound to Hybond paper. Sequences of short oligonucleotides can also be analyzed by laser desorption mass spectroscopy or by fast atom bombardment (McNeal, et al., 1982, *J. Am. Chem. Soc.* 104:976; Viari, et al., 1987, *Biomed. Environ. Mass Spectrom.* 14:83; Grotjahn et al., 1982, *Nuc. Acid Res.* 10:4671). Sequencing methods are also available for RNA oligonucleotides.

The quality of oligonucleotides synthesized can be verified by testing the oligonucleotide by capillary electrophoresis and denaturing strong anion HPLC (SAX-HPLC) using, e.g., the method of Bergot and Egan. 1992. *J. Chrom.* 599:35.

Other exemplary synthesis techniques are well known in the art (see, e.g., Sambrook et al., Molecular Cloning: a Laboratory Manual, Second Edition (1989); DNA Cloning, Volumes I and II (D N Glover Ed. 1985); Oligonucleotide Synthesis (M J Gait Ed, 1984; Nucleic Acid Hybridisation (B D Hames and S J Higgins eds. 1984); A Practical Guide to Molecular Cloning (1984); or the series, Methods in Enzymology (Academic Press, Inc.)).

In certain embodiments, the subject RNAi constructs or at least portions thereof are transcribed from expression vectors encoding the subject constructs. Any art recognized vectors may be use for this purpose. The transcribed RNAi constructs may be isolated and purified, before desired modifications (such as replacing an unmodified sense strand with a modified one, etc.) are carried out.

Delivery/Carrier
Uptake of Oligonucleotides by Cells

Oligonucleotides and oligonucleotide compositions are contacted with (i.e., brought into contact with, also referred to herein as administered or delivered to) and taken up by one or more cells or a cell lysate. The term "cells" includes prokaryotic and eukaryotic cells, preferably vertebrate cells, and, more preferably, mammalian cells. In a preferred embodiment, the oligonucleotide compositions of the invention are contacted with human cells.

Oligonucleotide compositions of the invention can be contacted with cells in vitro, e.g., in a test tube or culture dish, (and may or may not be introduced into a subject) or in vivo, e.g., in a subject such as a mammalian subject. Oligonucleotides are taken up by cells at a slow rate by endocytosis, but endocytosed oligonucleotides are generally sequestered and not available, e.g., for hybridization to a target nucleic acid molecule. In one embodiment, cellular uptake can be facilitated by electroporation or calcium phosphate precipitation. However, these procedures are only useful for in vitro or ex vivo embodiments, are not convenient and, in some cases, are associated with cell toxicity.

In another embodiment, delivery of oligonucleotides into cells can be enhanced by suitable art recognized methods including calcium phosphate, DMSO, glycerol or dextran, electroporation, or by transfection, e.g., using cationic, anionic, or neutral lipid compositions or liposomes using methods known in the art (see e.g., WO 90/14074; WO 91/16024; WO 91/17424; U.S. Pat. No. 4,897,355; Bergan et al. 1993. *Nucleic Acids Research.* 21:3567). Enhanced delivery of oligonucleotides can also be mediated by the use of vectors (See e.g., Shi, Y. 2003. Trends Genet 2003 Jan. 19:9; Reichhart J. M et al. Genesis. 2002. 34(1-2):1604, Yu et al. 2002. Proc. Natl. Acad. Sci. USA 99:6047; Sui et al. 2002. Proc. Natl. Acad. Sci. USA 99:5515) viruses, polyamine or polycation conjugates using compounds such as polylysine, protamine, or Ni, N12-bis(ethyl) spermine (see, e.g., Bartzatt, R. et al. 1989. *Biotechnol. Appl. Biochem.* 11:133; Wagner E. et al. 1992. *Proc. Natl. Acad. Sci.* 88:4255).

In certain embodiments, the miniRNA of the invention may be delivered by using various beta-glucan containing particles, such as those described in US 2005/0281781 A1, WO 2006/007372, and WO 2007/050643 (all incorporated herein by reference). In certain embodiments, the beta-glucan particle is derived from yeast. In certain embodiments, the payload trapping molecule is a polymer, such as those with a molecular weight of at least about 1000 Da, 10,000 Da, 50,000 Da, 100 kDa, 500 kDa, etc. Preferred polymers include (without limitation) cationic polymers, chitosans, or PEI (polyethylenimine), etc.

Such beta-glucan based delivery system may be formulated for oral delivery, where the orally delivered beta-glucan/miniRNA constructs may be engulfed by macrophages or other related phagocytic cells, which may in turn release the miniRNA constructs in selected in vivo sites. Alternatively or in addition, the miniRNA may changes the expression of certain macrophage target genes.

The optimal protocol for uptake of oligonucleotides will depend upon a number of factors, the most crucial being the type of cells that are being used. Other factors that are important in uptake include, but are not limited to, the nature and concentration of the oligonucleotide, the confluence of the cells, the type of culture the cells are in (e.g., a suspension culture or plated) and the type of media in which the cells are grown.
Encapsulating Agents Encapsulating agents entrap oligonucleotides within vesicles. In another embodiment of the invention, an oligonucleotide may be associated with a carrier or vehicle, e.g., liposomes or micelles, although other carriers could be used, as would be appreciated by one skilled in the art. Liposomes are vesicles made of a lipid bilayer having a structure similar to biological membranes. Such carriers are used to facilitate the cellular uptake or targeting of the oligonucleotide, or improve the oligonucleotide's pharmacokinetic or toxicologic properties.

For example, the oligonucleotides of the present invention may also be administered encapsulated in liposomes, pharmaceutical compositions wherein the active ingredient is contained either dispersed or variously present in corpuscles consisting of aqueous concentric layers adherent to lipidic layers. The oligonucleotides, depending upon solubility, may be present both in the aqueous layer and in the lipidic layer, or in what is generally termed a liposomic suspension. The hydrophobic layer, generally but not exclusively, comprises phospholipids such as lecithin and sphingomyelin, steroids such as cholesterol, more or less ionic surfactants such as diacetylphosphate, stearylamine, or phosphatidic acid, or other materials of a hydrophobic nature. The diameters of the liposomes generally range from about 15 nm to about 5 microns.

A "hydrophobic modified polynucleotide" as used herein is a polynucleotide of the invention (i.e. sd-rxRNA) that has at least one modification that renders the polynucleotide more hydrophobic than the polynucleotide was prior to modification. The modification may be achieved by attaching (covalently or non-covalently) a hydrophobic molecule to the polynucleotide. In some instances the hydrophobic molecule is or includes a lipophilic group.

The term "lipophilic group" means a group that has a higher affinity for lipids than its affinity for water. Examples of lipophilic groups include, but are not limited to, cholesterol, a cholesteryl or modified cholesteryl residue, adamantine, dihydrotesterone, long chain alkyl, long chain alkenyl, long chain alkynyl, olely-lithocholic, cholenic, oleoyl-cholenic, palmityl, heptadecyl, myrisityl, bile acids, cholic acid or taurocholic acid, deoxycholate, oleyl litocholic acid, oleoyl cholenic acid, glycolipids, phospholipids, sphingolipids, isoprenoids, such as steroids, vitamins, such as vitamin E, fatty acids either saturated or unsaturated, fatty acid esters, such as triglycerides, pyrenes, porphyrines, Texaphyrine, adamantane, acridines, biotin, coumarin, fluorescein, rhodamine, Texas-Red, digoxygenin, dimethoxytrityl, t-butyldimethylsilyl, t-butyldiphenylsilyl, cyanine dyes (e.g. Cy3 or Cy5), Hoechst 33258 dye, psoralen, or ibuprofen. The cholesterol moiety may be reduced (e.g. as in cholestan) or may be substituted (e.g. by halogen). A combination of different lipophilic groups in one molecule is also possible.

The hydrophobic molecule may be attached at various positions of the polynucleotide. As described above, the hydrophobic molecule may be linked to the terminal residue of the polynucleotide such as the 3' of 5'-end of the polynucleotide. Alternatively, it may be linked to an internal nucleotide or a nucleotide on a branch of the polynucleotide. The hydrophobic molecule may be attached, for instance to a 2'-position of the nucleotide. The hydrophobic molecule may also be linked to the heterocyclic base, the sugar or the backbone of a nucleotide of the polynucleotide.

The hydrophobic molecule may be connected to the polynucleotide by a linker moiety. Optionally the linker moiety is a non-nucleotidic linker moiety. Non-nucleotidic linkers are e.g. abasic residues (dSpacer), oligoethyleneglycol, such as triethyleneglycol (spacer 9) or hexaethylenegylcol (spacer 18), or alkane-diol, such as butanediol. The spacer units are preferably linked by phosphodiester or phosphorothioate bonds. The linker units may appear just once in the molecule or may be incorporated several times, e.g. via phosphodiester, phosphorothioate, methylphosphonate, or amide linkages.

Typical conjugation protocols involve the synthesis of polynucleotides bearing an aminolinker at one or more positions of the sequence, however, a linker is not required. The amino group is then reacted with the molecule being conjugated using appropriate coupling or activating reagents. The conjugation reaction may be performed either with the polynucleotide still bound to a solid support or following cleavage of the polynucleotide in solution phase. Purification of the modified polynucleotide by HPLC typically results in a pure material.

In some embodiments the hydrophobic molecule is a sterol type conjugate, a PhytoSterol conjugate, cholesterol conjugate, sterol type conjugate with altered side chain length, fatty acid conjugate, any other hydrophobic group conjugate, and/or hydrophobic modifications of the internal nucleoside, which provide sufficient hydrophobicity to be incorporated into micelles.

For purposes of the present invention, the term "sterols", refers or steroid alcohols are a subgroup of steroids with a hydroxyl group at the 3-position of the A-ring. They are amphipathic lipids synthesized from acetyl-coenzyme A via the HMG-CoA reductase pathway. The overall molecule is quite flat. The hydroxyl group on the A ring is polar. The rest of the aliphatic chain is non-polar. Usually sterols are considered to have an 8 carbon chain at position 17.

For purposes of the present invention, the term "sterol type molecules", refers to steroid alcohols, which are similar in structure to sterols. The main difference is the structure of the ring and number of carbons in a position 21 attached side chain.

For purposes of the present invention, the term "PhytoSterols" (also called plant sterols) are a group of steroid alcohols, phytochemicals naturally occurring in plants. There are more then 200 different known PhytoSterols For purposes of the present invention, the term "Sterol side chain" refers to a chemical composition of a side chain attached at the position 17 of sterol-type molecule. In a standard definition sterols are limited to a 4 ring structure carrying a 8 carbon chain at position 17. In this invention, the sterol type molecules with side chain longer and shorter than conventional are described. The side chain may branched or contain double back bones.

Figure 9:
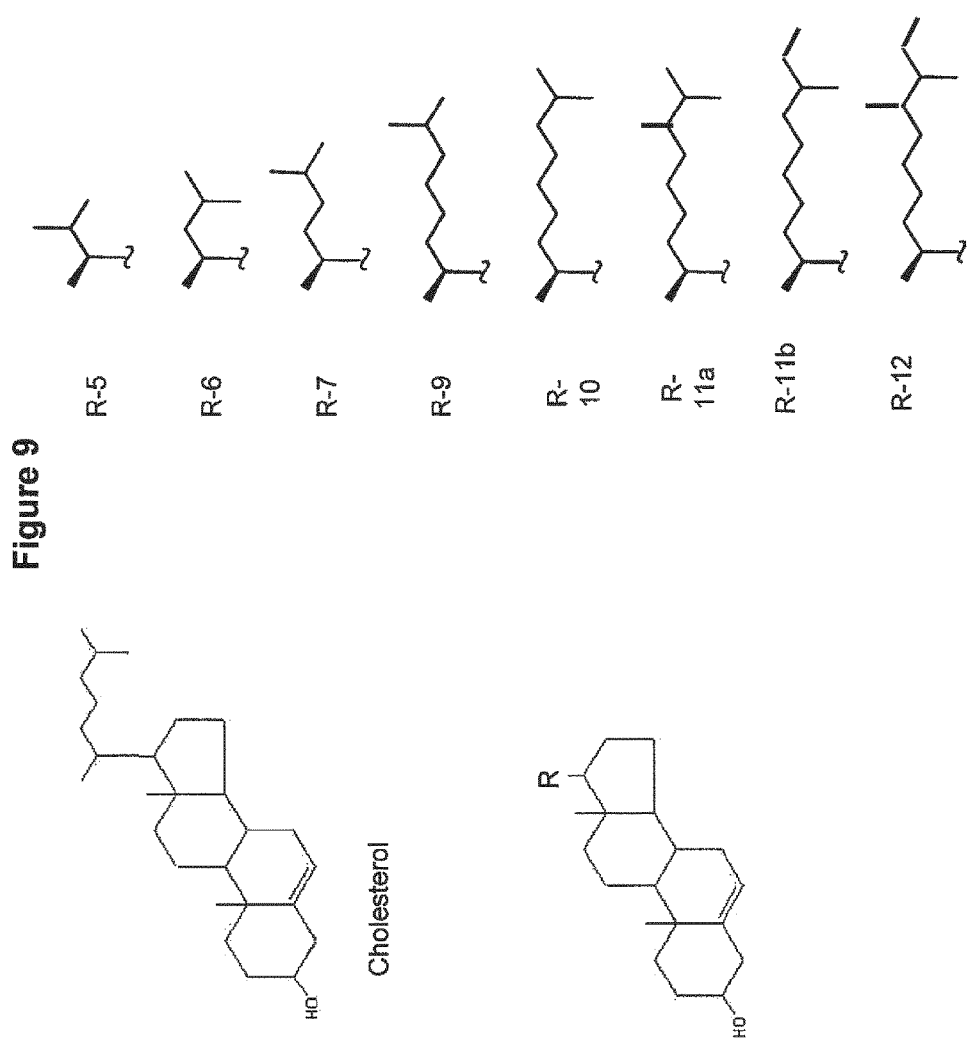
FIG. 9 is a schematic depicting examples of sterol-like structures, with variations in the size of the polycarbon chains attached at position 17.

Thus, sterols useful in the invention, for example, include cholesterols, as well as unique sterols in which position 17 has attached side chain of 2-7 or longer then 9 carbons. In a particular embodiment, the length of the polycarbon tail is varied between 5 and 9 carbons. FIG. 9 demonstrates that there is a correlation between plasma clearance, liver uptake and the length of the polycarbon chain. Such conjugates may have significantly better in vivo efficacy, in particular delivery to liver. These types of molecules are expected to work at concentrations 5 to 9 fold lower then oligonucleotides conjugated to conventional cholesterols.

Alternatively the polynucleotide may be bound to a protein, peptide or positively charged chemical that functions as the hydrophobic molecule. The proteins may be selected from the group consisting of protamine, dsRNA binding domain, and arginine rich peptides. Exemplary positively charged chemicals include spermine, spermidine, cadaverine, and putrescine.

In another embodiment hydrophobic molecule conjugates may demonstrate even higher efficacy when it is combined with optimal chemical modification patterns of the polynucleotide (as described herein in detail), containing but not limited to hydrophobic modifications, phosphorothioate modifications, and 2' ribo modifications.

Figure 8:
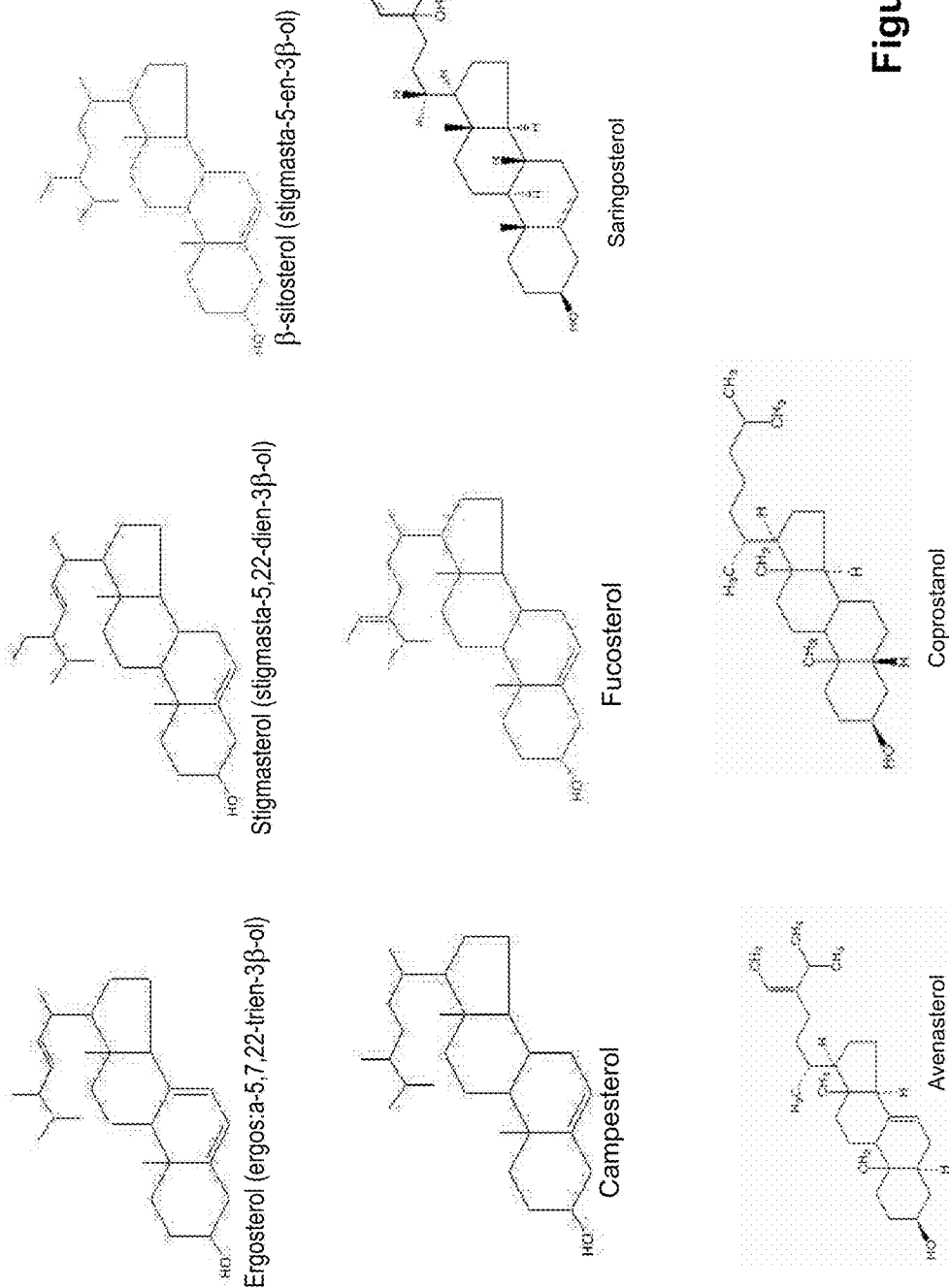
FIG. 8 is a schematic depicting examples of naturally occurring phytosterols with a polycarbon chain that is longer than 8, attached at position 17. More than 250 different types of phytosterols are known.

In another embodiment the sterol type molecule may be a naturally occurring PhytoSterols such as those shown in FIG. 8. The polycarbon chain may be longer than 9 and may be linear, branched and/or contain double bonds. Some PhytoSterol containing polynucleotide conjugates may be significantly more potent and active in delivery of polynucleotides to various tissues. Some PhytoSterols may demonstrate tissue preference and thus be used as a way to delivery RNAi specifically to particular tissues.

Targeting Agents

The delivery of oligonucleotides can also be improved by targeting the oligonucleotides to a cellular receptor. The targeting moieties can be conjugated to the oligonucleotides or attached to a carrier group (i.e., poly(L-lysine) or liposomes) linked to the oligonucleotides. This method is well suited to cells that display specific receptor-mediated endocytosis.

For instance, oligonucleotide conjugates to 6-phosphomannosylated proteins are internalized 20-fold more efficiently by cells expressing mannose 6-phosphate specific receptors than free oligonucleotides. The oligonucleotides may also be coupled to a ligand for a cellular receptor using a biodegradable linker. In another example, the delivery construct is mannosylated streptavidin which forms a tight complex with biotinylated oligonucleotides. Mannosylated streptavidin was found to increase 20-fold the internalization of biotinylated oligonucleotides. (Vlassov et al. 1994. *Biochimica et Biophysica Acta* 1197:95-108).

In addition specific ligands can be conjugated to the polylysine component of polylysine-based delivery systems. For example, transferrin-polylysine, adenovirus-polylysine, and influenza virus hemagglutinin HA-2 N-terminal fusogenic peptides-polylysine conjugates greatly enhance receptor-mediated DNA delivery in eucaryotic cells. Mannosylated glycoprotein conjugated to poly(L-lysine) in aveolar macrophages has been employed to enhance the cellular uptake of oligonucleotides. Liang et al. 1999. *Pharmazie* 54:559-566.

Because malignant cells have an increased need for essential nutrients such as folic acid and transferrin, these nutrients can be used to target oligonucleotides to cancerous cells. For example, when folic acid is linked to poly(L-lysine) enhanced oligonucleotide uptake is seen in promyelocytic leukaemia (HL-60) cells and human melanoma (M-14) cells. Ginobbi et al. 1997. *Anticancer Res.* 17:29. In another example, liposomes coated with maleylated bovine serum albumin, folic acid, or ferric protoporphyrin IX, show enhanced cellular uptake of oligonucleotides in murine macrophages, KB cells, and 2.2.15 human hepatoma cells. Liang et al. 1999. *Pharmazie* 54:559-566.

Liposomes naturally accumulate in the liver, spleen, and reticuloendothelial system (so-called, passive targeting). By coupling liposomes to various ligands such as antibodies are protein A, they can be actively targeted to specific cell populations. For example, protein A-bearing liposomes may be pretreated with H-2K specific antibodies which are targeted to the mouse major histocompatibility complex-encoded H-2K protein expressed on L cells. (Vlassov et al. 1994. *Biochimica et Biophysica Acta* 1197:95-108).

Other in vitro and/or in vivo delivery of RNAi reagents are known in the art, and can be used to deliver the subject RNAi constructs. See, for example, U.S. patent application publications 20080152661, 20080112916, 20080107694, 20080038296, 20070231392, 20060240093, 20060178327, 20060008910, 20050265957, 20050064595, 20050042227, 20050037496, 20050026286, 20040162235, 20040072785, 20040063654, 20030157030, WO 2008/036825, WO04/065601, and AU2004206255B2, just to name a few (all incorporated by reference).

Administration

The optimal course of administration or delivery of the oligonucleotides may vary depending upon the desired result and/or on the subject to be treated. As used herein "administration" refers to contacting cells with oligonucleotides and can be performed in vitro or in vivo. The dosage of oligonucleotides may be adjusted to optimally reduce expression of a protein translated from a target nucleic acid molecule, e.g., as measured by a readout of RNA stability or by a therapeutic response, without undue experimentation.

For example, expression of the protein encoded by the nucleic acid target can be measured to determine whether or not the dosage regimen needs to be adjusted accordingly. In addition, an increase or decrease in RNA or protein levels in a cell or produced by a cell can be measured using any art recognized technique. By determining whether transcription has been decreased, the effectiveness of the oligonucleotide in inducing the cleavage of a target RNA can be determined.

Any of the above-described oligonucleotide compositions can be used alone or in conjunction with a pharmaceutically acceptable carrier. As used herein, "pharmaceutically acceptable carrier" includes appropriate solvents, dispersion media, coatings, antibacterial and antifungal agents, isotonic and absorption delaying agents, and the like. The use of such media and agents for pharmaceutical active substances is well known in the art. Except insofar as any conventional media or agent is incompatible with the active ingredient, it can be used in the therapeutic compositions. Supplementary active ingredients can also be incorporated into the compositions.

Oligonucleotides may be incorporated into liposomes or liposomes modified with polyethylene glycol or admixed with cationic lipids for parenteral administration. Incorporation of additional substances into the liposome, for example, antibodies reactive against membrane proteins found on specific target cells, can help target the oligonucleotides to specific cell types.

Moreover, the present invention provides for administering the subject oligonucleotides with an osmotic pump providing continuous infusion of such oligonucleotides, for example, as described in Rataiczak et al. (1992 *Proc. Natl. Acad. Sci. USA* 89:11823-11827). Such osmotic pumps are commercially available, e.g., from Alzet Inc. (Palo Alto, Calif.). Topical administration and parenteral administration in a cationic lipid carrier are preferred.

With respect to in vivo applications, the formulations of the present invention can be administered to a patient in a variety of forms adapted to the chosen route of administration, e.g., parenterally, orally, or intraperitoneally. Parenteral administration, which is preferred, includes administration by the following routes: intravenous; intramuscular; interstitially; intraarterially; subcutaneous; intra ocular; intrasynovial; trans epithelial, including transdermal; pulmonary via inhalation; ophthalmic; sublingual and buccal; topically, including ophthalmic; dermal; ocular; rectal; and nasal inhalation via insufflation.

Pharmaceutical preparations for parenteral administration include aqueous solutions of the active compounds in water-soluble or water-dispersible form. In addition, suspensions of the active compounds as appropriate oily injection suspensions may be administered. Suitable lipophilic solvents or vehicles include fatty oils, for example, sesame oil, or synthetic fatty acid esters, for example, ethyl oleate or triglycerides. Aqueous injection suspensions may contain substances which increase the viscosity of the suspension include, for example, sodium carboxymethyl cellulose, sorbitol, or dextran, optionally, the suspension may also contain stabilizers. The oligonucleotides of the invention can be formulated in liquid solutions, preferably in physiologically compatible buffers such as Hank's solution or Ringer's solution. In addition, the oligonucleotides may be formulated in solid form and redissolved or suspended immediately prior to use. Lyophilized forms are also included in the invention.

Pharmaceutical preparations for topical administration include transdermal patches, ointments, lotions, creams, gels, drops, sprays, suppositories, liquids and powders. In addition, conventional pharmaceutical carriers, aqueous, powder or oily bases, or thickeners may be used in pharmaceutical preparations for topical administration.

Pharmaceutical preparations for oral administration include powders or granules, suspensions or solutions in water or non-aqueous media, capsules, sachets or tablets. In addition, thickeners, flavoring agents, diluents, emulsifiers, dispersing aids, or binders may be used in pharmaceutical preparations for oral administration.

For transmucosal or transdermal administration, penetrants appropriate to the barrier to be permeated are used in the formulation. Such penetrants are known in the art, and include, for example, for transmucosal administration bile salts and fusidic acid derivatives, and detergents. Transmucosal administration may be through nasal sprays or using suppositories. For oral administration, the oligonucleotides are formulated into conventional oral administration forms such as capsules, tablets, and tonics. For topical administration, the oligonucleotides of the invention are formulated into ointments, salves, gels, or creams as known in the art.

Drug delivery vehicles can be chosen e.g., for in vitro, for systemic, or for topical administration. These vehicles can be designed to serve as a slow release reservoir or to deliver their contents directly to the target cell. An advantage of using some direct delivery drug vehicles is that multiple molecules are delivered per uptake. Such vehicles have been shown to increase the circulation half-life of drugs that would otherwise be rapidly cleared from the blood stream. Some examples of such specialized drug delivery vehicles which fall into this category are liposomes, hydrogels, cyclodextrins, biodegradable nanocapsules, and bioadhesive microspheres.

The described oligonucleotides may be administered systemically to a subject. Systemic absorption refers to the entry of drugs into the blood stream followed by distribution throughout the entire body. Administration routes which lead to systemic absorption include: intravenous, subcutaneous, intraperitoneal, and intranasal. Each of these administration routes delivers the oligonucleotide to accessible diseased cells. Following subcutaneous administration, the therapeutic agent drains into local lymph nodes and proceeds through the lymphatic network into the circulation. The rate of entry into the circulation has been shown to be a function of molecular weight or size. The use of a liposome or other drug carrier localizes the oligonucleotide at the lymph node. The oligonucleotide can be modified to diffuse into the cell, or the liposome can directly participate in the delivery of either the unmodified or modified oligonucleotide into the cell.

The chosen method of delivery will result in entry into cells. Preferred delivery methods include liposomes (10-400 nm), hydrogels, controlled-release polymers, and other pharmaceutically applicable vehicles, and microinjection or electroporation (for ex vivo treatments).

The pharmaceutical preparations of the present invention may be prepared and formulated as emulsions. Emulsions are usually heterogeneous systems of one liquid dispersed in another in the form of droplets usually exceeding 0.1 µm in diameter. The emulsions of the present invention may contain excipients such as emulsifiers, stabilizers, dyes, fats, oils, waxes, fatty acids, fatty alcohols, fatty esters, humectants, hydrophilic colloids, preservatives, and anti-oxidants may also be present in emulsions as needed. These excipients may be present as a solution in either the aqueous phase, oily phase or itself as a separate phase.

Examples of naturally occurring emulsifiers that may be used in emulsion formulations of the present invention include lanolin, beeswax, phosphatides, lecithin and acacia. Finely divided solids have also been used as good emulsifiers especially in combination with surfactants and in viscous preparations. Examples of finely divided solids that may be used as emulsifiers include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

Examples of preservatives that may be included in the emulsion formulations include methyl paraben, propyl paraben, quaternary ammonium salts, benzalkonium chloride, esters of p-hydroxybenzoic acid, and boric acid. Examples of antioxidants that may be included in the emulsion formulations include free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

In one embodiment, the compositions of oligonucleotides are formulated as microemulsions. A microemulsion is a system of water, oil and amphiphile which is a single optically isotropic and thermodynamically stable liquid solution. Typically microemulsions are prepared by first dispersing an oil in an aqueous surfactant solution and then adding a sufficient amount of a 4th component, generally an intermediate chain-length alcohol to form a transparent system.

Surfactants that may be used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules.

Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain ($C_8$-$C_{12}$) mono, di, and tri-glycerides, polyoxyethylated glyceryl fatty acid esters, fatty alcohols, polyglycolized glycerides, saturated polyglycolized $C_8$-$C_{10}$ glycerides, vegetable oils and silicone oil.

Microemulsions are particularly of interest from the standpoint of drug solubilization and the enhanced absorption of drugs. Lipid based microemulsions (both oil/water and water/oil) have been proposed to enhance the oral bioavailability of drugs.

Microemulsions offer improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11:1385; Ho et al., J. Pharm. Sci., 1996, 85:138-143). Microemulsions have also been effective in the transdermal delivery of active components in both cosmetic and pharmaceutical applications. It is expected that the microemulsion compositions and formulations of the present invention will facilitate the increased systemic absorption of oligonucleotides from the gastrointestinal tract, as well as improve the local cellular uptake of oligonucleotides within the gastrointestinal tract, vagina, buccal cavity and other areas of administration.

In an embodiment, the present invention employs various penetration enhancers to affect the efficient delivery of nucleic acids, particularly oligonucleotides, to the skin of animals. Even non-lipophilic drugs may cross cell membranes if the membrane to be crossed is treated with a penetration enhancer. In addition to increasing the diffusion of non-lipophilic drugs across cell membranes, penetration enhancers also act to enhance the permeability of lipophilic drugs.

Five categories of penetration enhancers that may be used in the present invention include: surfactants, fatty acids, bile salts, chelating agents, and non-chelating non-surfactants. Other agents may be utilized to enhance the penetration of the administered oligonucleotides include: glycols such as ethylene glycol and propylene glycol, pyrrols such as 2-15 pyrrol, azones, and terpenes such as limonene, and menthone.

The oligonucleotides, especially in lipid formulations, can also be administered by coating a medical device, for example, a catheter, such as an angioplasty balloon catheter, with a cationic lipid formulation. Coating may be achieved, for example, by dipping the medical device into a lipid formulation or a mixture of a lipid formulation and a suitable solvent, for example, an aqueous-based buffer, an aqueous solvent, ethanol, methylene chloride, chloroform and the like. An amount of the formulation will naturally adhere to the surface of the device which is subsequently administered to a patient, as appropriate. Alternatively, a lyophilized mixture of a lipid formulation may be specifically bound to the surface of the device. Such binding techniques are described, for example, in K. Ishihara et al., Journal of Biomedical Materials Research, Vol. 27, pp. 1309-1314 (1993), the disclosures of which are incorporated herein by reference in their entirety.

The useful dosage to be administered and the particular mode of administration will vary depending upon such factors as the cell type, or for in vivo use, the age, weight and the particular animal and region thereof to be treated, the particular oligonucleotide and delivery method used, the therapeutic or diagnostic use contemplated, and the form of the formulation, for example, suspension, emulsion, micelle or liposome, as will be readily apparent to those skilled in the art. Typically, dosage is administered at lower levels and increased until the desired effect is achieved. When lipids are used to deliver the oligonucleotides, the amount of lipid compound that is administered can vary and generally depends upon the amount of oligonucleotide agent being administered. For example, the weight ratio of lipid compound to oligonucleotide agent is preferably from about 1:1 to about 15:1, with a weight ratio of about 5:1 to about 10:1 being more preferred. Generally, the amount of cationic lipid compound which is administered will vary from between about 0.1 milligram (mg) to about 1 gram (g). By way of general guidance, typically between about 0.1 mg and about 10 mg of the particular oligonucleotide agent, and about 1 mg to about 100 mg of the lipid compositions, each per kilogram of patient body weight, is administered, although higher and lower amounts can be used.

The agents of the invention are administered to subjects or contacted with cells in a biologically compatible form suitable for pharmaceutical administration. By "biologically compatible form suitable for administration" is meant that the oligonucleotide is administered in a form in which any toxic effects are outweighed by the therapeutic effects of the oligonucleotide. In one embodiment, oligonucleotides can be administered to subjects. Examples of subjects include mammals, e.g., humans and other primates; cows, pigs, horses, and farming (agricultural) animals; dogs, cats, and other domesticated pets; mice, rats, and transgenic non-human animals.

Administration of an active amount of an oligonucleotide of the present invention is defined as an amount effective, at dosages and for periods of time necessary to achieve the desired result. For example, an active amount of an oligonucleotide may vary according to factors such as the type of cell, the oligonucleotide used, and for in vivo uses the disease state, age, sex, and weight of the individual, and the ability of the oligonucleotide to elicit a desired response in the individual. Establishment of therapeutic levels of oligonucleotides within the cell is dependent upon the rates of uptake and efflux or degradation. Decreasing the degree of degradation prolongs the intracellular half-life of the oligonucleotide. Thus, chemically-modified oligonucleotides, e.g., with modification of the phosphate backbone, may require different dosing.

The exact dosage of an oligonucleotide and number of doses administered will depend upon the data generated experimentally and in clinical trials. Several factors such as the desired effect, the delivery vehicle, disease indication, and the route of administration, will affect the dosage. Dosages can be readily determined by one of ordinary skill in the art and formulated into the subject pharmaceutical compositions. Preferably, the duration of treatment will extend at least through the course of the disease symptoms.

Dosage regime may be adjusted to provide the optimum therapeutic response. For example, the oligonucleotide may be repeatedly administered, e.g., several doses may be administered daily or the dose may be proportionally reduced as indicated by the exigencies of the therapeutic situation. One of ordinary skill in the art will readily be able to determine appropriate doses and schedules of administration of the subject oligonucleotides, whether the oligonucleotides are to be administered to cells or to subjects.

Physical methods of introducing nucleic acids include injection of a solution containing the nucleic acid, bombardment by particles covered by the nucleic acid, soaking the cell or organism in a solution of the nucleic acid, or electroporation of cell membranes in the presence of the nucleic acid. A viral construct packaged into a viral particle would accomplish both efficient introduction of an expression construct into the cell and transcription of nucleic acid encoded by the expression construct. Other methods known in the art for introducing nucleic acids to cells may be used, such as lipid-mediated carrier transport, chemical-mediated transport, such as calcium phosphate, and the like. Thus the nucleic acid may be introduced along with components that perform one or more of the following activities: enhance nucleic acid uptake by the cell, inhibit annealing of single strands, stabilize the single strands, or other-wise increase inhibition of the target gene.

Nucleic acid may be directly introduced into the cell (i.e., intracellularly); or introduced extracellularly into a cavity, interstitial space, into the circulation of an organism, introduced orally or by inhalation, or may be introduced by bathing a cell or organism in a solution containing the nucleic acid. Vascular or extravascular circulation, the blood or lymph system, and the cerebrospinal fluid are sites where the nucleic acid may be introduced.

The cell with the target gene may be derived from or contained in any organism. The organism may a plant, animal, protozoan, bacterium, virus, or fungus. The plant may be a monocot, dicot or gymnosperm; the animal may be a vertebrate or invertebrate. Preferred microbes are those used in agriculture or by industry, and those that are pathogenic for plants or animals.

Alternatively, vectors, e.g., transgenes encoding a siRNA of the invention can be engineered into a host cell or transgenic animal using art recognized techniques.

Another use for the nucleic acids of the present invention (or vectors or transgenes encoding same) is a functional analysis to be carried out in eukaryotic cells, or eukaryotic non-human organisms, preferably mammalian cells or organisms and most preferably human cells, e.g. cell lines such as HeLa or 293 or rodents, e.g. rats and mice. By administering a suitable nucleic acid of the invention which is sufficiently complementary to a target mRNA sequence to direct target-specific RNA interference, a specific knockout or knockdown phenotype can be obtained in a target cell, e.g. in cell culture or in a target organism.

Thus, a further subject matter of the invention is a eukaryotic cell or a eukaryotic non-human organism exhibiting a target gene-specific knockout or knockdown phenotype comprising a fully or at least partially deficient expression of at least one endogenous target gene wherein said cell or organism is transfected with at least one vector comprising DNA encoding an RNAi agent capable of inhibiting the expression of the target gene. It should be noted that the present invention allows a target-specific knockout or knockdown of several different endogenous genes due to the specificity of the RNAi agent.

Gene-specific knockout or knockdown phenotypes of cells or non-human organisms, particularly of human cells or non-human mammals may be used in analytic to procedures, e.g. in the functional and/or phenotypical analysis of complex physiological processes such as analysis of gene expression profiles and/or proteomes. Preferably the analysis is carried out by high throughput methods using oligonucleotide based chips.

Therapeutic Use

By inhibiting the expression of a gene, the oligonucleotide compositions of the present invention can be used to treat any disease involving the expression of a protein. Examples of diseases that can be treated by oligonucleotide compositions, just to illustrate, include: cancer, retinopathies, autoimmune diseases, inflammatory diseases (i.e., ICAM-1 related disorders, Psoriasis, Ulcerative Colitus, Crohn's disease), viral diseases (i.e., HIV, Hepatitis C), miRNA disorders, and cardiovascular diseases.

In one embodiment, in vitro treatment of cells with oligonucleotides can be used for ex vivo therapy of cells removed from a subject (e.g., for treatment of leukemia or viral infection) or for treatment of cells which did not originate in the subject, but are to be administered to the subject (e.g., to eliminate transplantation antigen expression on cells to be transplanted into a subject). In addition, in vitro treatment of cells can be used in non-therapeutic settings, e.g., to evaluate gene function, to study gene regulation and protein synthesis or to evaluate improvements made to oligonucleotides designed to modulate gene expression or protein synthesis. In vivo treatment of cells can be useful in certain clinical settings where it is desirable to inhibit the expression of a protein. There are numerous medical conditions for which antisense therapy is reported to be suitable (see, e.g., U.S. Pat. No. 5,830,653) as well as respiratory syncytial virus infection (WO 95/22,553) influenza virus (WO 94/23,028), and malignancies (WO 94/08, 003). Other examples of clinical uses of antisense sequences are reviewed, e.g., in Glaser. 1996. *Genetic Engineering News* 16:1. Exemplary targets for cleavage by oligonucleotides include, e.g., protein kinase Ca, ICAM-1, c-raf kinase, p53, c-myb, and the bcr/abl fusion gene found in chronic myelogenous leukemia.

The subject nucleic acids can be used in RNAi-based therapy in any animal having RNAi pathway, such as human, non-human primate, non-human mammal, non-human vertebrates, rodents (mice, rats, hamsters, rabbits, etc.), domestic livestock animals, pets (cats, dogs, etc.), *Xenopus*, fish, insects (*Drosophila*, etc.), and worms (*C. elegans*), etc.

The invention provides methods for inhibiting or preventing in a subject, a disease or condition associated with an aberrant or unwanted target gene expression or activity, by administering to the subject a nucleic acid of the invention. If appropriate, subjects are first treated with a priming agent so as to be more responsive to the subsequent RNAi therapy. Subjects at risk for a disease which is caused or contributed to by aberrant or unwanted target gene expression or activity can be identified by, for example, any or a combination of diagnostic or prognostic assays known in the art. Administration of a prophylactic agent can occur prior to the manifestation of symptoms characteristic of the target gene aberrancy, such that a disease or disorder is prevented or, alternatively, delayed in its progression. Depending on the type of target gene aberrancy, for example, a target gene, target gene agonist or target gene antagonist agent can be used for treating the subject.

In another aspect, the invention pertains to methods of modulating target gene expression, protein expression or activity for therapeutic purposes. Accordingly, in an exemplary embodiment, the methods of the invention involve contacting a cell capable of expressing target gene with a nucleic acid of the invention that is specific for the target gene or protein (e.g., is specific for the mRNA encoded by said gene or specifying the amino acid sequence of said protein) such that expression or one or more of the activities of target protein is modulated. These methods can be performed in vitro (e.g., by culturing the cell with the agent), in vivo (e.g., by administering the agent to a subject), or ex vivo. The subjects may be first treated with a priming agent so as to be more responsive to the subsequent RNAi therapy if desired. As such, the present invention provides methods of treating a subject afflicted with a disease or disorder characterized by aberrant or unwanted expression or activity of a target gene polypeptide or nucleic acid molecule Inhibition of target gene activity is desirable in situations in which target gene is abnormally unregulated and/or in which decreased target gene activity is likely to have a beneficial effect.

Thus the therapeutic agents of the invention can be administered to subjects to treat (prophylactically or therapeutically) disorders associated with aberrant or unwanted target gene activity. In conjunction with such treatment, pharmacogenomics (i.e., the study of the relationship between an individual's genotype and that individual's response to a foreign compound or drug) may be considered. Differences in metabolism of therapeutics can lead to severe toxicity or therapeutic failure by altering the relation between dose and blood concentration of the pharmacologically active drug. Thus, a physician or clinician may consider applying knowledge obtained in relevant pharmacogenomics studies in determining whether to administer a therapeutic agent as well as tailoring the dosage and/or therapeutic regimen of treatment with a therapeutic agent. Pharmacogenomics deals with clinically significant hereditary variations in the response to drugs due to altered drug disposition and abnormal action in affected persons.

For the purposes of the invention, ranges may be expressed herein as from "about" one particular value, and/or to "about" another particular value. When such a range is expressed, another embodiment includes from the one particular value and/or to the other particular value. Similarly, when values are expressed as approximations, by use of the antecedent "about," it will be understood that the particular value forms another embodiment. It will be further understood that the endpoints of each of the ranges are significant both in relation to the other endpoint, and independently of the other endpoint.

Moreover, for the purposes of the present invention, the term "a" or "an" entity refers to one or more of that entity; for example, "a protein" or "a nucleic acid molecule" refers to one or more of those compounds or at least one compound. As such, the terms "a" (or "an"), "one or more" and "at least one" can be used interchangeably herein. It is also to be noted that the terms "comprising", "including", and "having" can be used interchangeably. Furthermore, a compound "selected from the group consisting of" refers to one or more of the compounds in the list that follows, including mixtures (i.e., combinations) of two or more of the compounds. According to the present invention, an isolated, or biologically pure, protein or nucleic acid molecule is a compound that has been removed from its natural milieu. As such, "isolated" and "biologically pure" do not necessarily reflect the extent to which the compound has been purified. An isolated compound of the present invention can be obtained from its natural source, can be produced using molecular biology techniques or can be produced by chemical synthesis.

The present invention is further illustrated by the following Examples, which in no way should be construed as further limiting. The entire contents of all of the references (including literature references, issued patents, published patent applications, and co-pending patent applications) cited throughout this application are hereby expressly incorporated by reference.

EXAMPLES

Example 1: Inhibition of Gene Expression Using Minimum Length Trigger RNAs

Transfection of Minimum Length Trigger (mlt) RNA
mltRNA constructs were chemically synthesized (Integrated DNA Technologies, Coralville, Iowa) and transfected into HEK293 cells (ATCC, Manassas, Va.) using the Lipofectamine RNAiMAX (Invitrogen, Carlsbad, Calif.) reagent according to manufacturer's instructions. In brief, RNA was diluted to a 12× concentration and then combined with a 12× concentration of Lipofectamine RNAiMAX to complex. The RNA and transfection reagent were allowed to complex at room temperature for 20 minutes and make a 6× concentration. While complexing, HEK293 cells were washed, trypsinized and counted. The cells were diluted to a concentration recommended by the manufacturer and previously described conditions which was at $1 \times 10^5$ cells/ml. When RNA had completed complexing with the RNAiMAX transfection reagent, 20 ul of the complexes were added to the appropriate well of the 96-well plate in triplicate. Cells were added to each well (100 ul volume) to make the final cell count per well at $1 \times 10^4$ cells/well. The volume of cells diluted the 6× concentration of complex to 1× which was equal to a concentration noted (between 10-0.05 nM). Cells were incubated for 24 or 48 hours under normal growth conditions.

After 24 or 48 hour incubation cells were lysed and gene silencing activity was measured using the QuantiGene assay (Panomics, Freemont, Calif.) which employs bDNA hybridization technology. The assay was carried out according to manufacturer's instructions.

ΔG Calculation

ΔG was calculated using Mfold, available through the Mfold internet site (http://mfold.bioinfo.rpi.edu/cgi-bin/rna-form1.cgi). Methods for calculating ΔG are described in, and are incorporated by reference from, the following references: Zuker, M. (2003) Nucleic Acids Res., 31(13):3406-15; Mathews, D. H., Sabina, J., Zuker, M. and Turner, D. H. (1999) J. Mol. Biol. 288:911-940; Mathews, D. H., Disney, M. D., Childs, J. L., Schroeder, S. J., Zuker, M., and Turner, D. H. (2004) Proc. Natl. Acad. Sci. 101:7287-7292; Duan, S., Mathews, D. H., and Turner, D. H. (2006) Biochemistry 45:9819-9832; Wuchty, S., Fontana, W., Hofacker, I. L., and Schuster, P. (1999) Biopolymers 49:145-165.

Example 2: Optimization of sd-rxRNA$^{nano}$ Molecules for Gene Silencing

Asymmetric double stranded RNAi molecules, with minimal double stranded regions, were developed herein and are highly effective at gene silencing. These molecules can contain a variety of chemical modifications on the sense and/or anti-sense strands, and can be conjugated to sterol-like compounds such as cholesterol.

Figure 2:
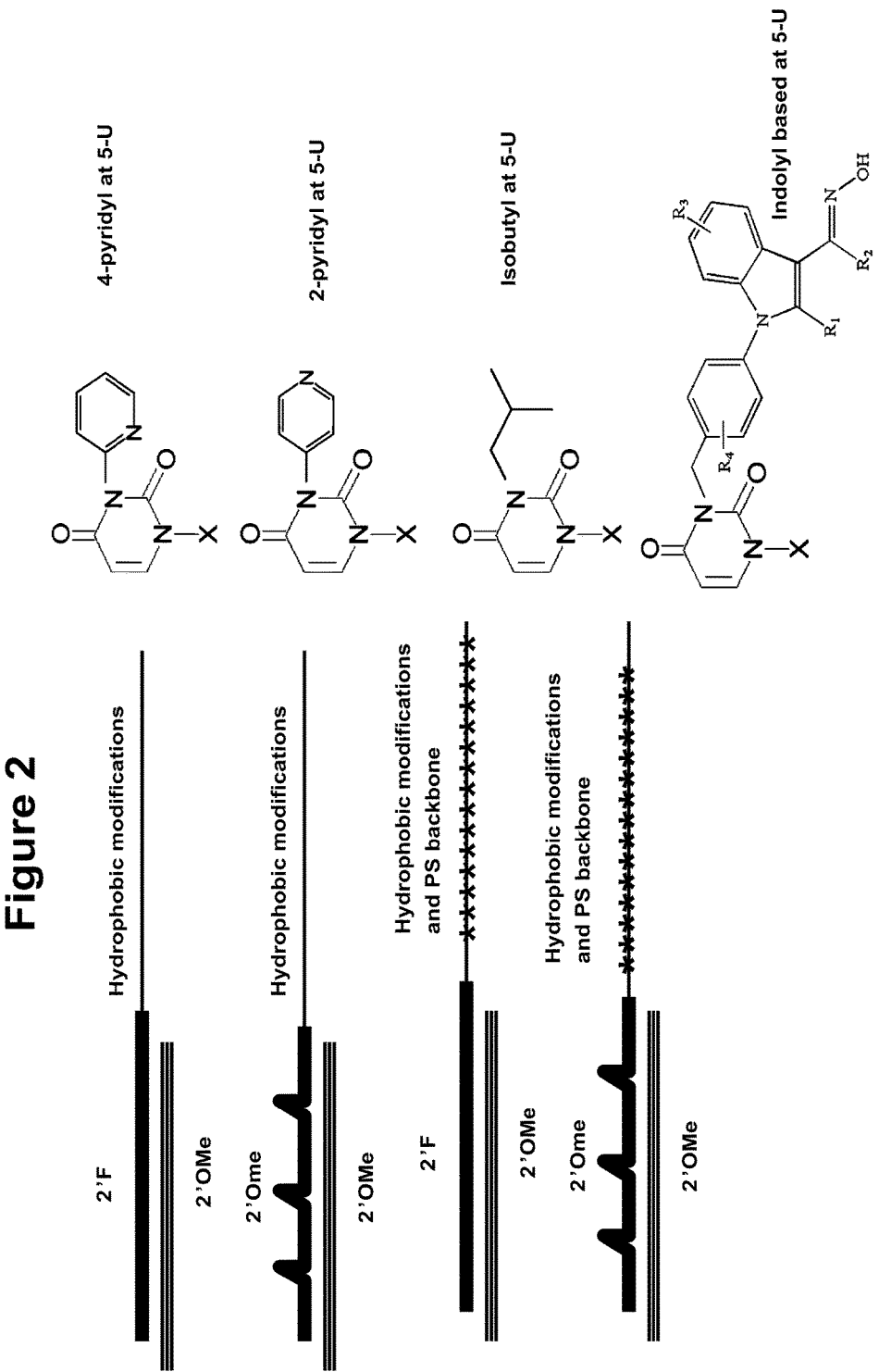
FIG. 2 is a schematic depicting asymmetric dsRNA molecules with different chemical modification patterns. Several examples of chemical modifications that might be used to increase hydrophobicity are shown including 4-pyridyl, 2-pyridyl, isobutyl and indolyl based position 5 uridine modifications.
Figure 3:
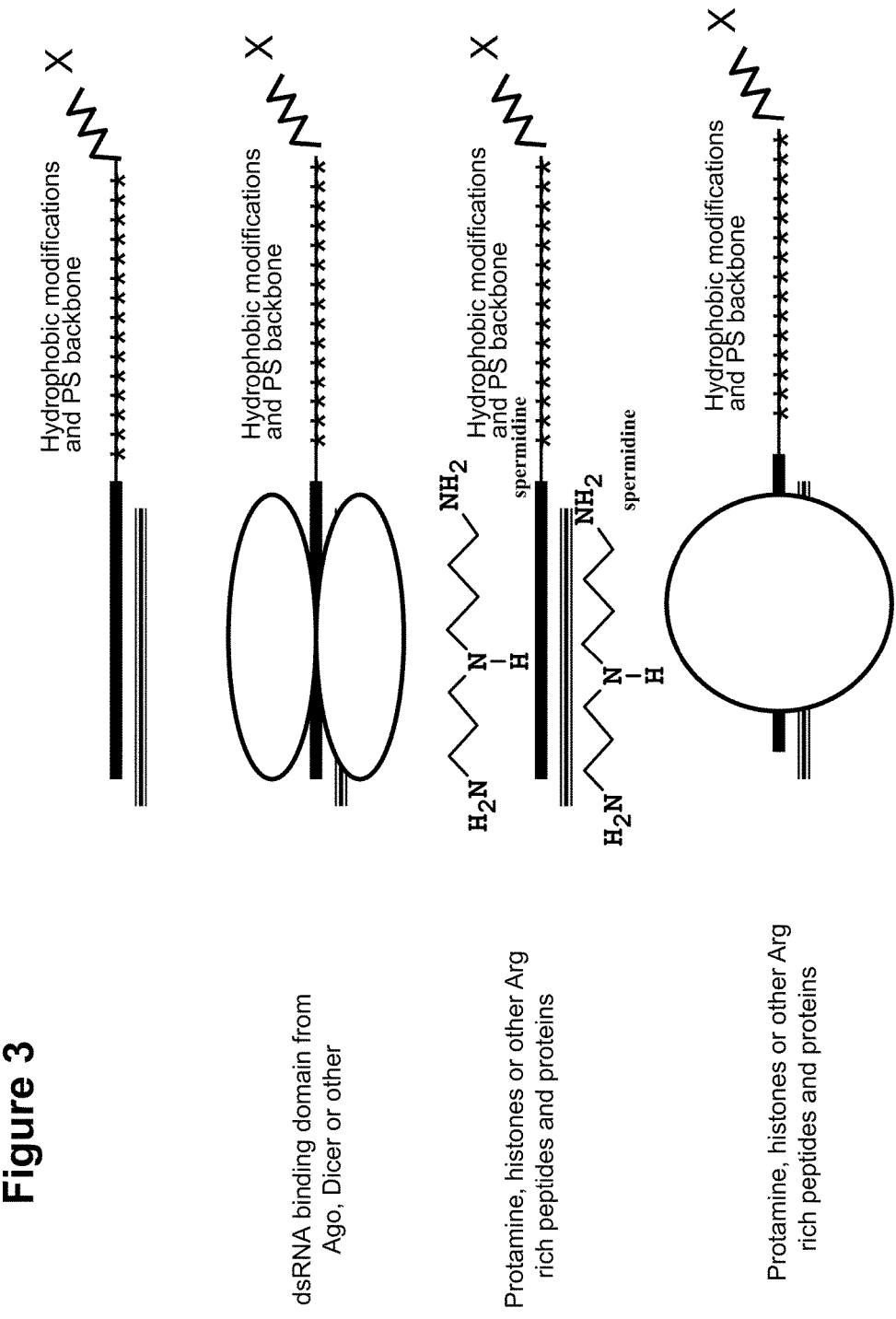
FIG. 3 is a schematic depicting the use of dsRNA binding domains, protamine (or other Arg rich peptides), spermidine or similar chemical structures to block duplex charge to facilitate cellular entry.
Figure 4:
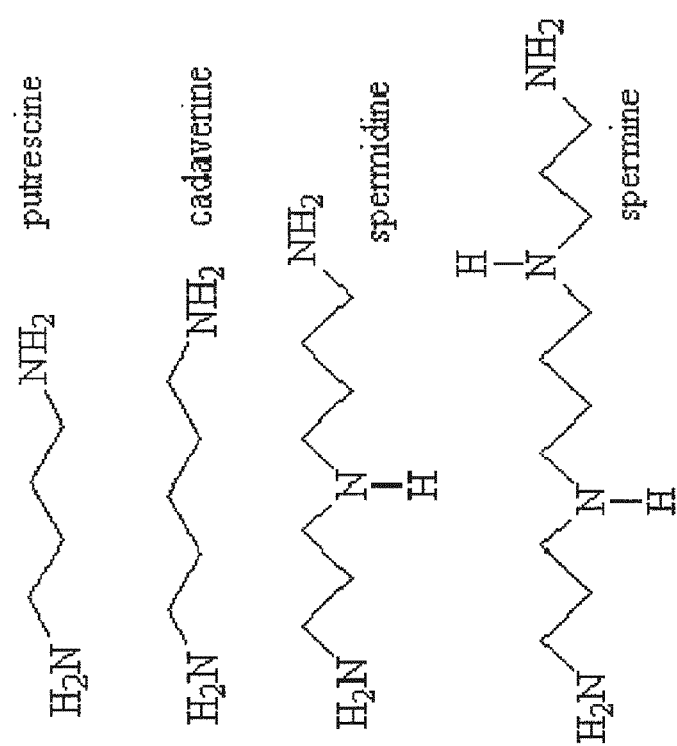
FIG. 4 is a schematic depicting positively charged chemicals that might be used for polynucleotide charge blockage.

FIGS. 1-3 present schematics of RNAi molecules associated with the invention. In the asymmetric molecules, which contain a sense and anti-sense strand, either of the strands can be the longer strand. Either strand can also contain a single-stranded region. There can also be mismatches between the sense and anti-sense strand, as indicated in FIG. 1D. Preferably, one end of the double-stranded molecule is either blunt-ended or contains a short overhang such as an overhang of one nucleotide. FIG. 2 indicates types of chemical modifications applied to the sense and anti-sense strands including 2'F, 2'OMe, hydrophobic modifications and phosphorothioate modifications. Preferably, the single stranded region of the molecule contains multiple phosphorothioate modifications. Hydrophobicity of molecules can be increased using such compounds as 4-pyridyl at 5-U, 2-pyridyl at 5-U, isobutyl at 5-U and indolyl at 5-U (FIG. 2). Proteins or peptides such as protamine (or other Arg rich peptides), spermidine or other similar chemical structures can also be used to block duplex charge and facilitate cellular entry (FIG. 3). Increased hydrophobicity can be achieved through either covalent or non-covalent modifications. Several positively charged chemicals, which might be used for polynucleotide charge blockage are depicted in FIG. 4.

Chemical modifications of polynucleotides, such as the guide strand in a duplex molecule, can facilitate RISC entry. FIG. 5 depicts single stranded polynucleotides, representing a guide strand in a duplex molecule, with a variety of chemical modifications including 2'd, 2'OMe, 2'F, hydrophobic modifications, phosphorothioate modifications, and attachment of conjugates such as "X" in FIG. 5, where X can be a small molecule with high affinity to a PAZ domain, or sterol-type entity. Similarly, FIG. 6 depicts single stranded polynucleotides, representing a passenger strand in a duplex molecule, with proposed structural and chemical compositions of RISC substrate inhibitors. Combinations of chemical modifications can ensure efficient uptake and efficient binding to preloaded RISC complexes.

Figure 7:
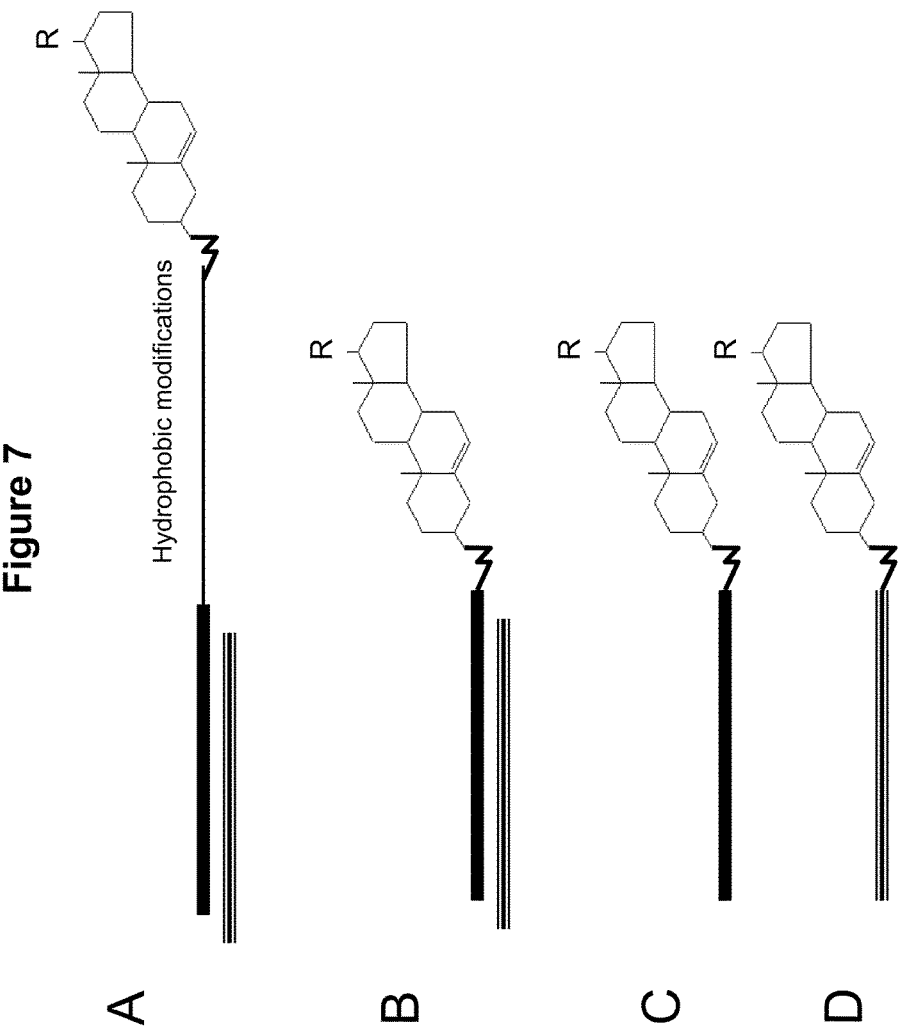
FIG. 7 is a schematic depicting structures of polynucleotides with sterol type molecules attached, where R represent a polycarbonic tail of 9 carbons or longer.
Figure 11:
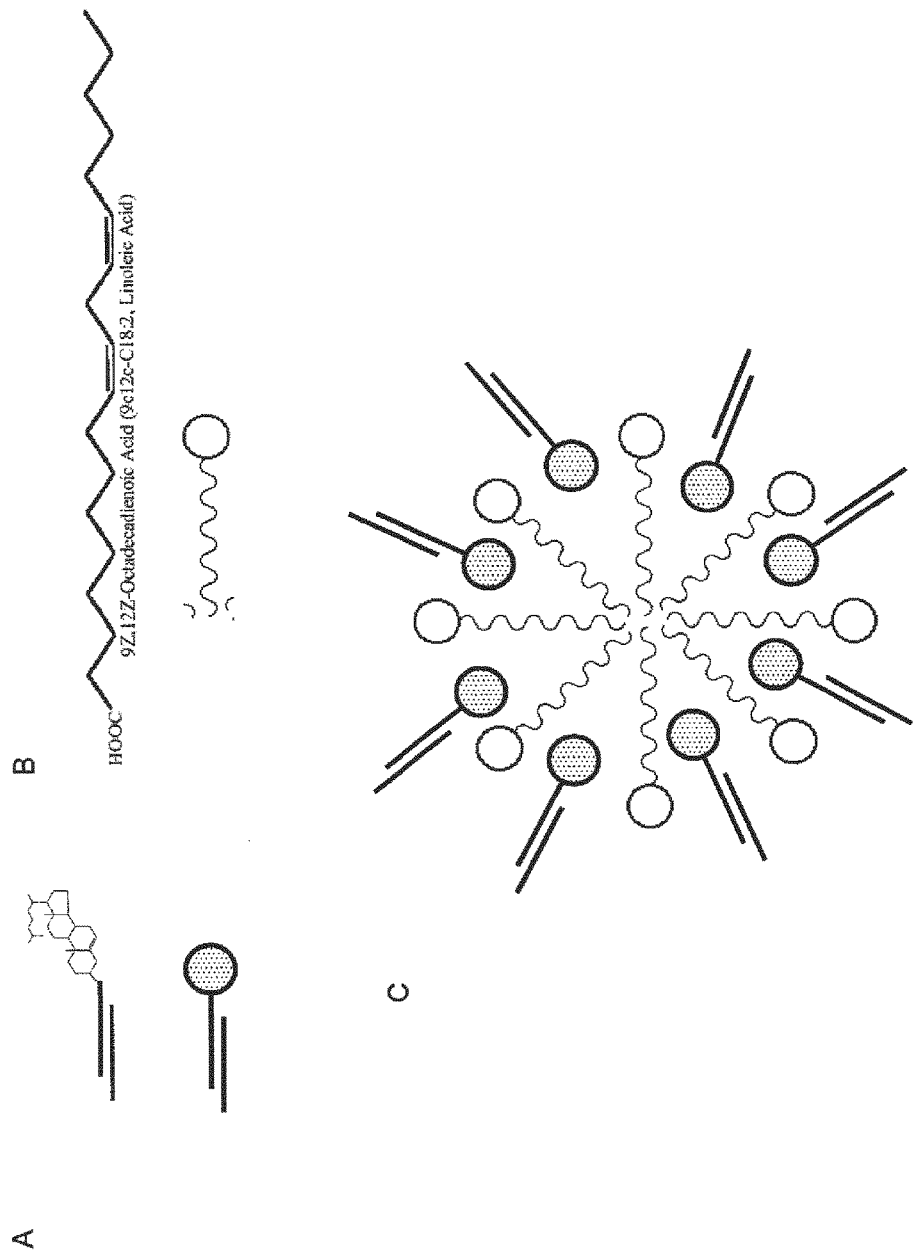
FIG. 11 is a schematic depicting micelle formation.
Figure 12:
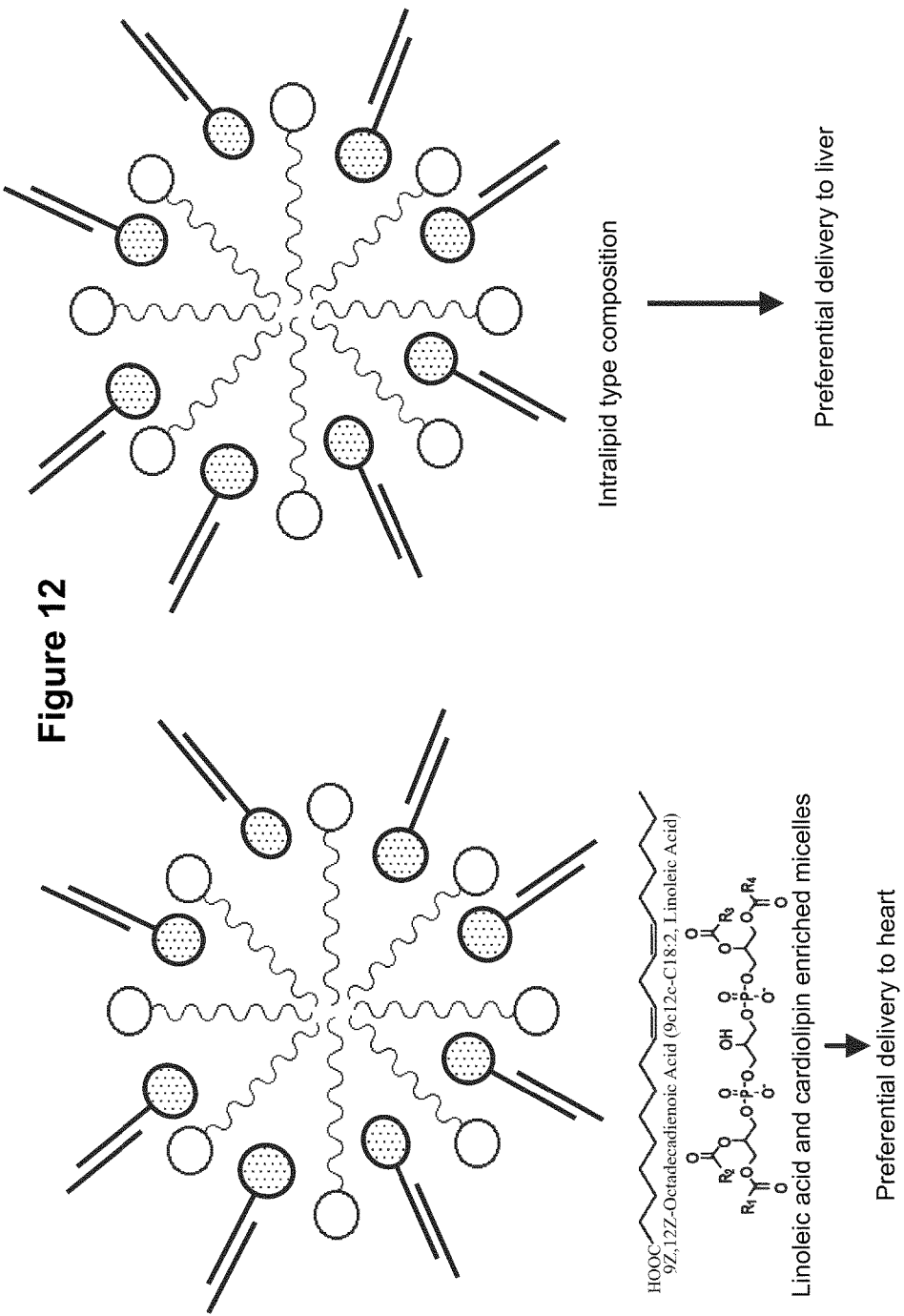
FIG. 12 is a schematic depicting how alteration in lipid composition can affect pharmacokinetic behavior and tissue distribution of hydrophobically modified and/or hydrophobically conjugated polynucleotides. In particular, use of lipid mixtures enriched in linoleic acid and cardiolipin results in preferential uptake by cardiomyocites.
Figure 91:
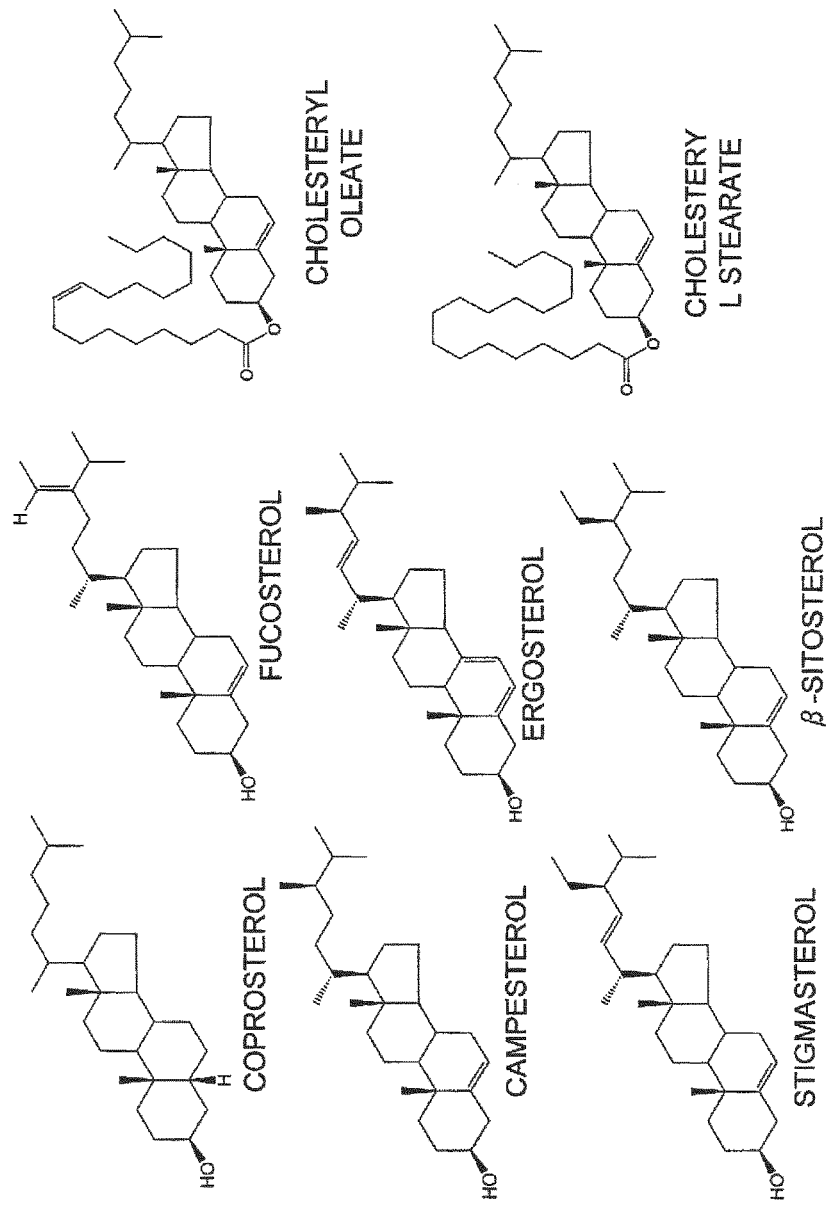
FIG. 91 is a schematic depicting a panel of sterol-type molecules which can be used as a hydrophobic entity in place of cholesterol. In some instances, the use of sterol-type molecules comprising longer chains results in generation of sd-rxRNA compounds with significantly better cellular uptake and tissue distribution properties.
Figure 92:
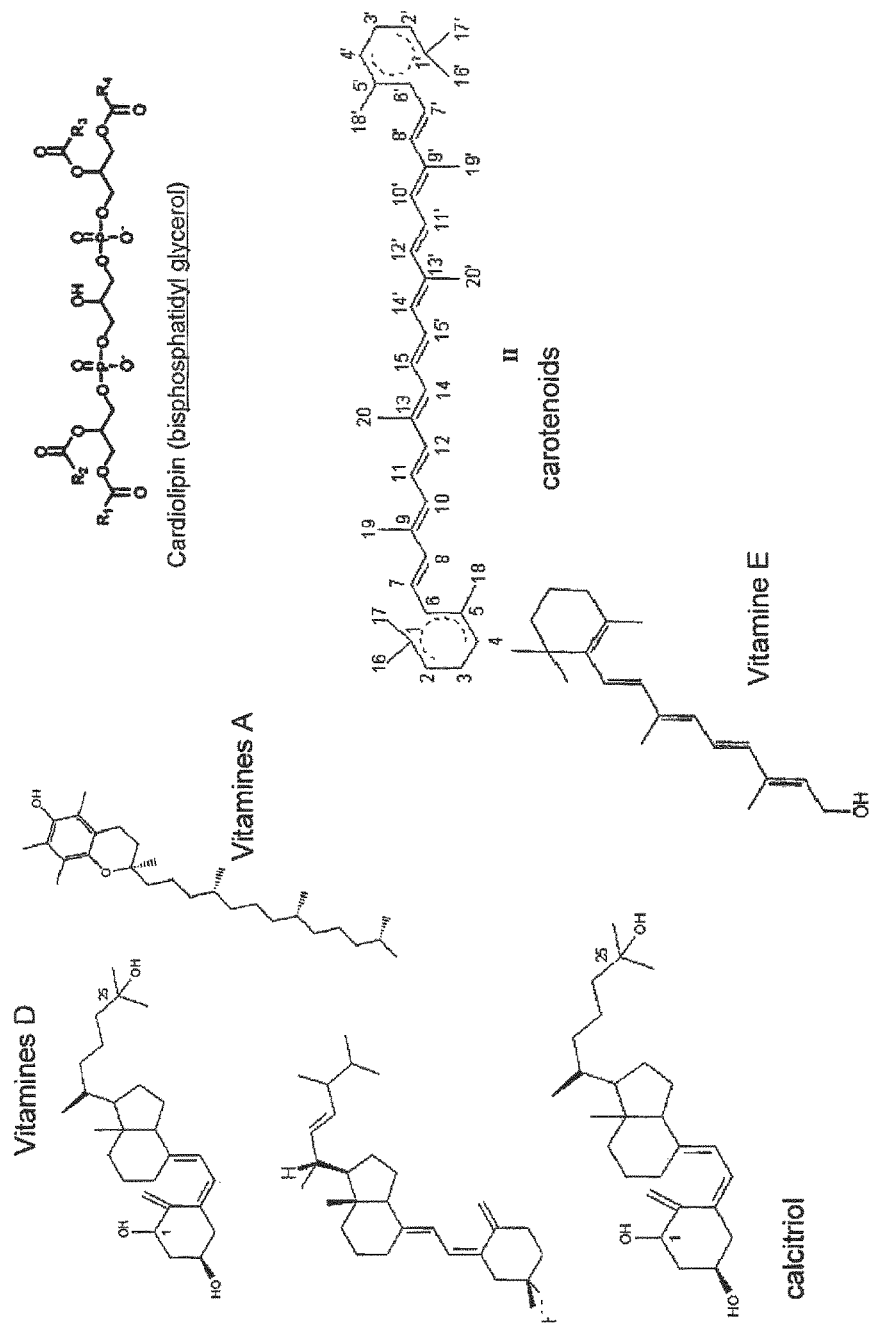
FIG. 92 presents schematics depicting a panel of hydrophobic molecules which might be used as a hydrophobic entity in place of cholesterol. These list just provides representative examples; any small molecule with substantial hydrophobicity can be used.

FIG. 7 depicts structures of polynucleotides with sterol-type molecules attached, where R represents a polycarbonic tail of 9 carbons or longer. FIG. 8 presents examples of naturally occurring phytosterols with a polycarbon chain longer than 8 attached at position 17. More than 250 different types of phytosterols are known. FIG. 9 presents examples of sterol-like structures with variations in the sizes of the polycarbon chains attached at position 17. FIG. 91 presents further examples of sterol-type molecules that can be used as a hydrophobic entity in place of cholesterol. FIG. 92 presents further examples of hydrophobic molecules that might be used as hydrophobic entities in place of cholestesterol. Optimization of such characteristics can improve uptake properties of the RNAi molecules. FIG. 10 presents data adapted from Martins et al. (J Lipid Research), showing that the percentage of liver uptake and plasma clearance of lipid emulsions containing sterol-type molecules is directly affected by the size of the attached polycarbon chain at position 17. FIG. 11 depicts a micelle formed from a mixture of polynucleotides attached to hydrophobic conjugates and fatty acids. FIG. 12 describes how alteration in lipid composition can affect pharmacokinetic behavior and tissue distribution of hydrophobically modified and/or hydrophobically conjugated polynucleotides. In particular, the use of lipid mixtures that are enriched in linoleic acid and cardiolipin results in preferential uptake by cardiomyocytes.

Figure 13:
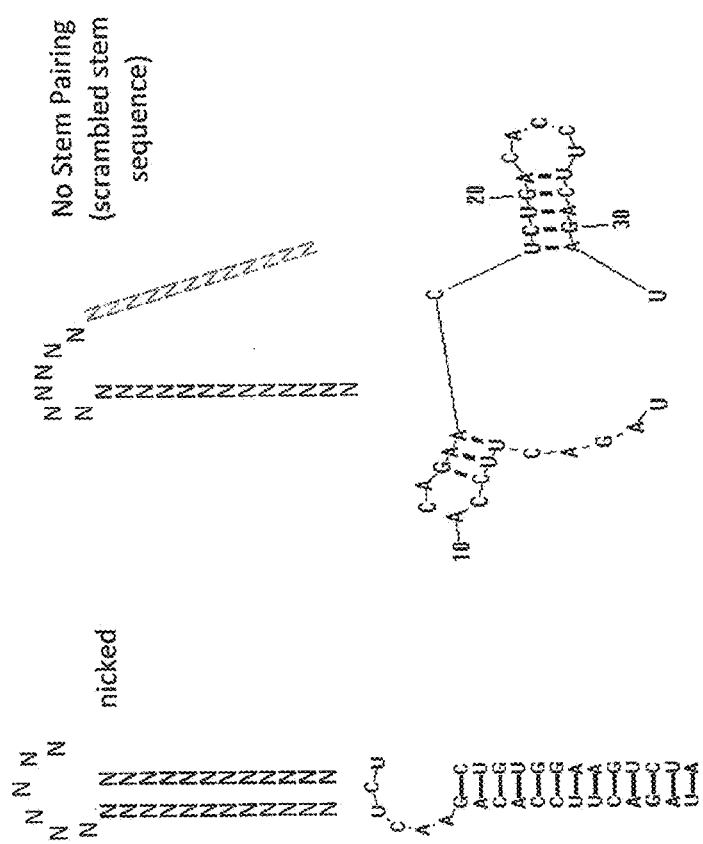
FIG. 13 is a schematic showing examples of RNAi constructs and controls used to target MAP4K4 expression. RNAi construct 12083 corresponds to SEQ ID NOs:597 and 598. RNAi construct 12089 corresponds to SEQ ID NO:599.
Figure 14:
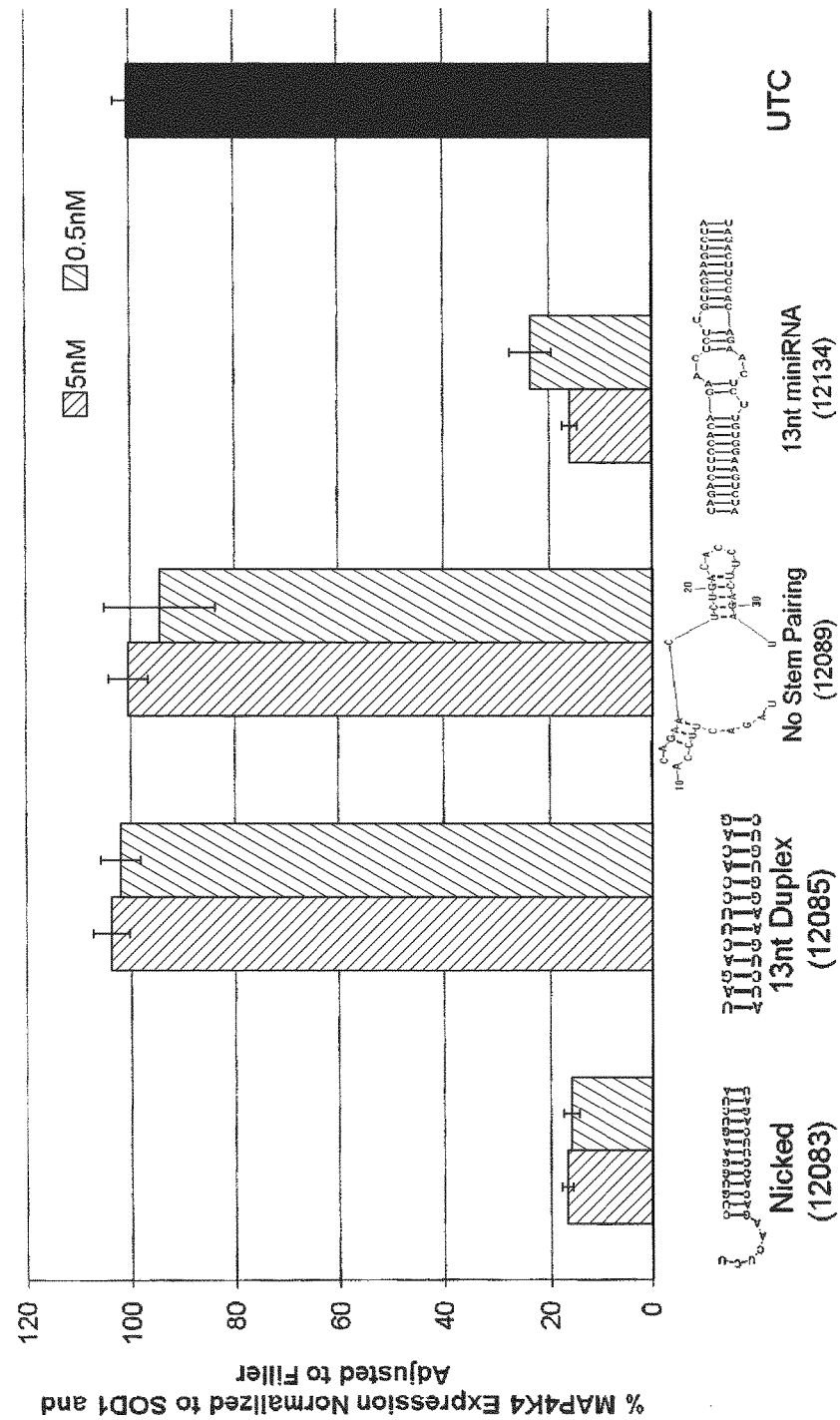
FIG. 14 is a graph showing MAP4K4 expression following transfection with RNAi constructs associated with the invention. RNAi constructs tested were: 12083 (Nicked), 12085 (13nt Duplex), 12089 (No Stem Pairing) and 12134 (13nt miniRNA). Results of transfection were compared to an untransfected control sample. RNAi construct 12083 corresponds to SEQ ID NOs:597 and 598. RNAi construct 12085 corresponds to SEQ ID NOs:600 and 601. RNAi construct 12089 corresponds to SEQ ID NO:599. RNAi construct 12134 corresponds to SEQ ID NOs:602 and 603.
Figure 15:
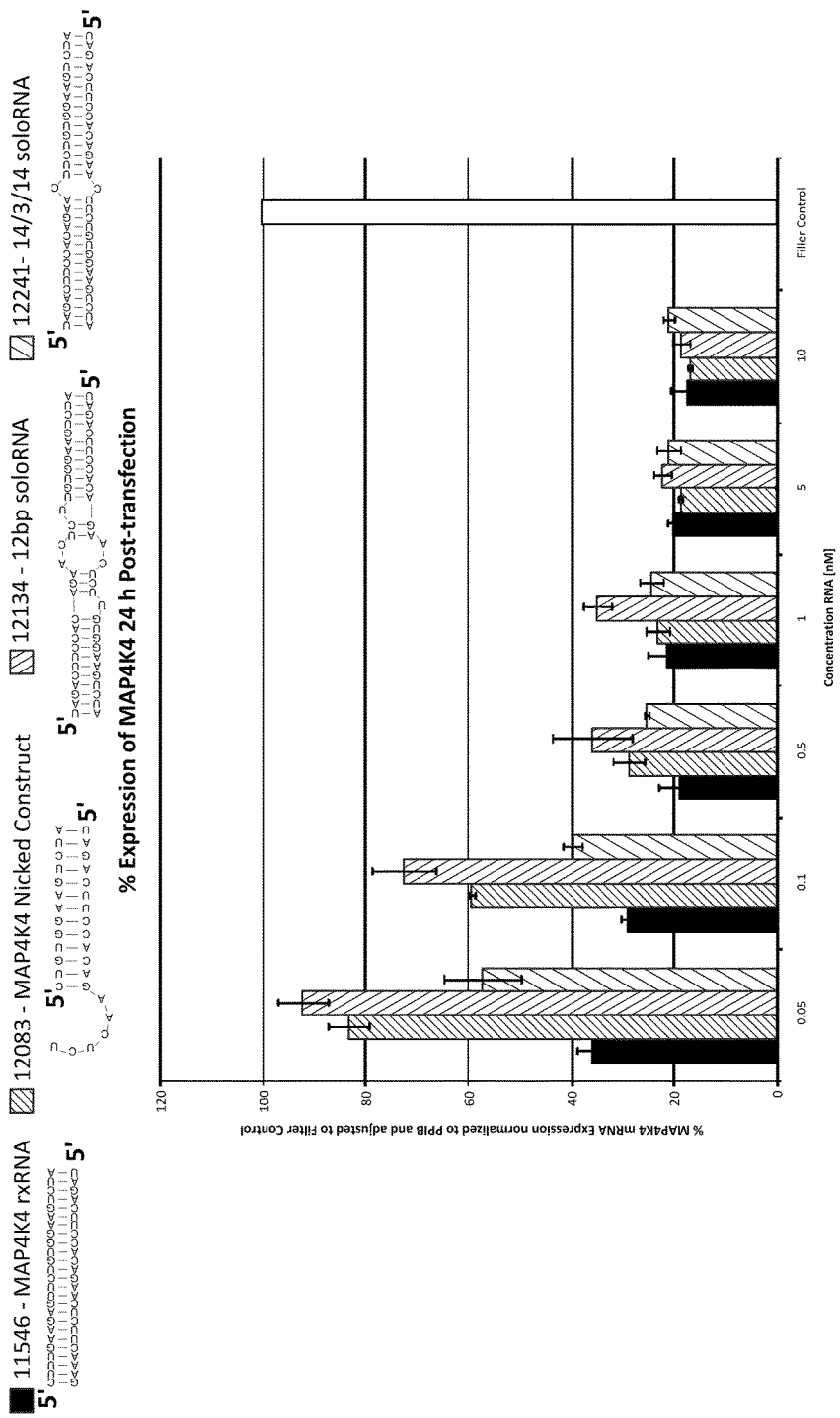
FIG. 15 is a graph showing expression of MAP4K4 24 hours post-transfection with RNAi constructs associated with the invention. RNAi constructs tested were: 11546 (MAP4K4 rxRNA), 12083 (MAP4K4 Nicked Construct), 12134 (12 bp soloRNA) and 12241 (14/3/14 soloRNA). Results of transfection were compared to a filler control sample. RNAi construct 11546 corresponds to SEQ ID NOs:604 and 605. RNAi construct 12083 corresponds to SEQ ID NOs:597 and 598. RNAi construct 12134 corresponds to SEQ ID NOs:602 and 603. RNAi construct 12241 corresponds to SEQ ID NOs:606 and 607.
Figure 16:
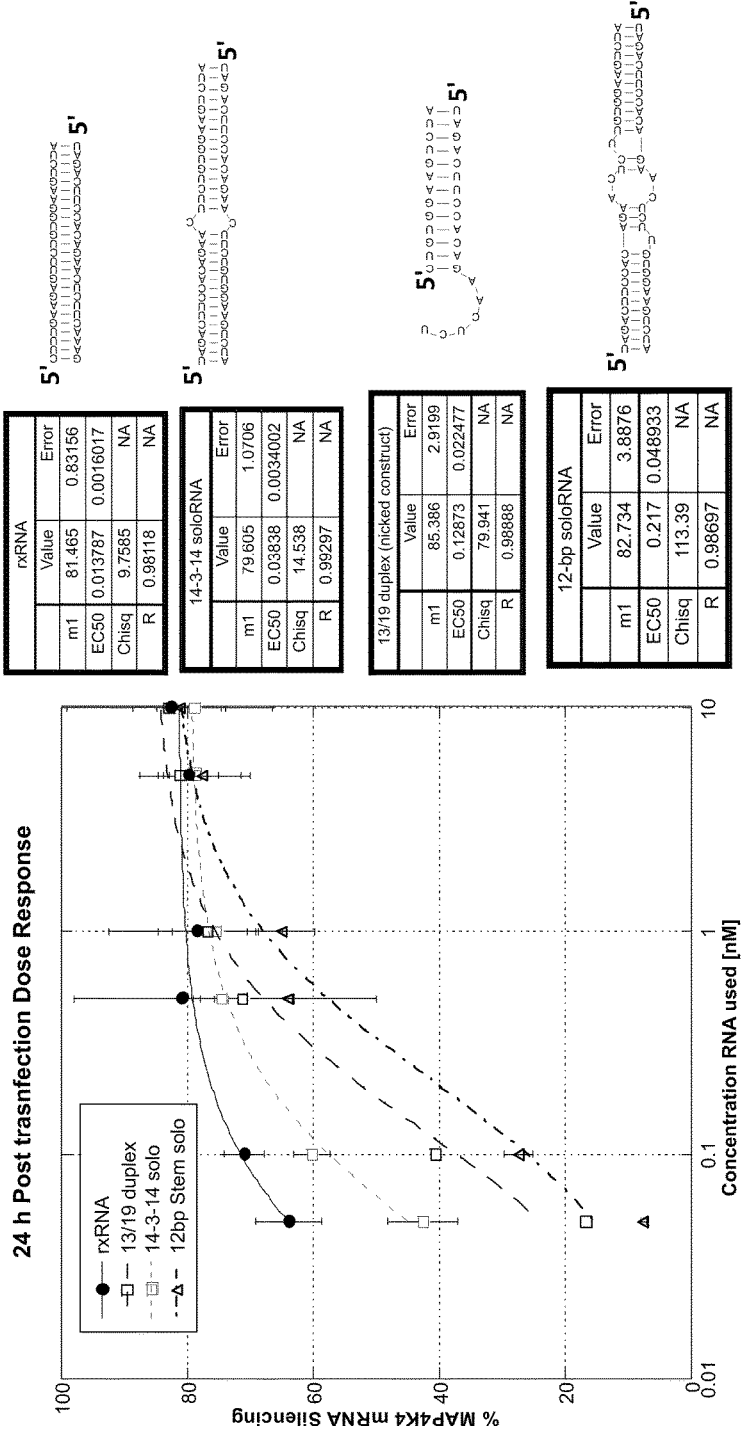
FIG. 16 presents a graph and several tables comparing parameters associated with silencing of MAP4K4 expression following transfection with RNAi constructs associated with the invention. The rxRNA construct corresponds to SEQ ID NOs:604 and 605. The 14-3-14 soloRNA construct corresponds to SEQ ID NOs:606 and 607. The 13/19 duplex (nicked construct) corresponds to SEQ ID NOs:597 and 598. The 12-bp soloRNA construct corresponds to SEQ ID NOs:602 and 603.
Figure 17:
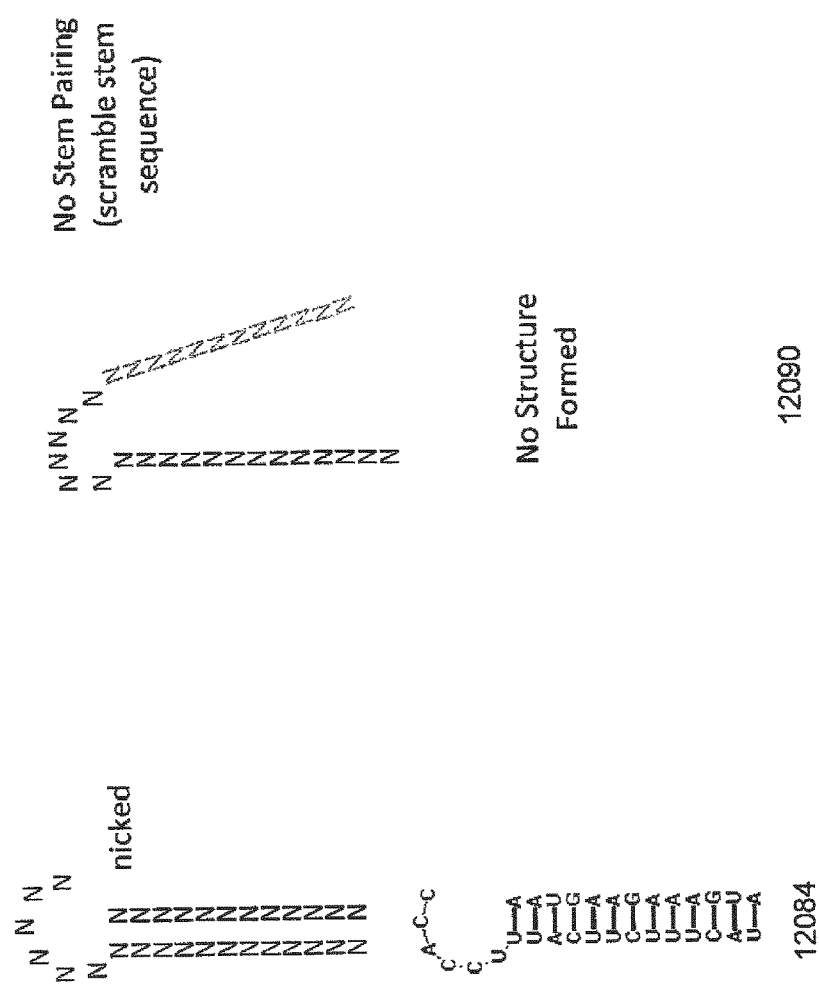
FIG. 17 is a schematic showing examples of RNAi constructs and controls used to target SOD1 expression. The 12084 RNAi construct corresponds to SEQ ID NOs:612 and 613.
Figure 18:
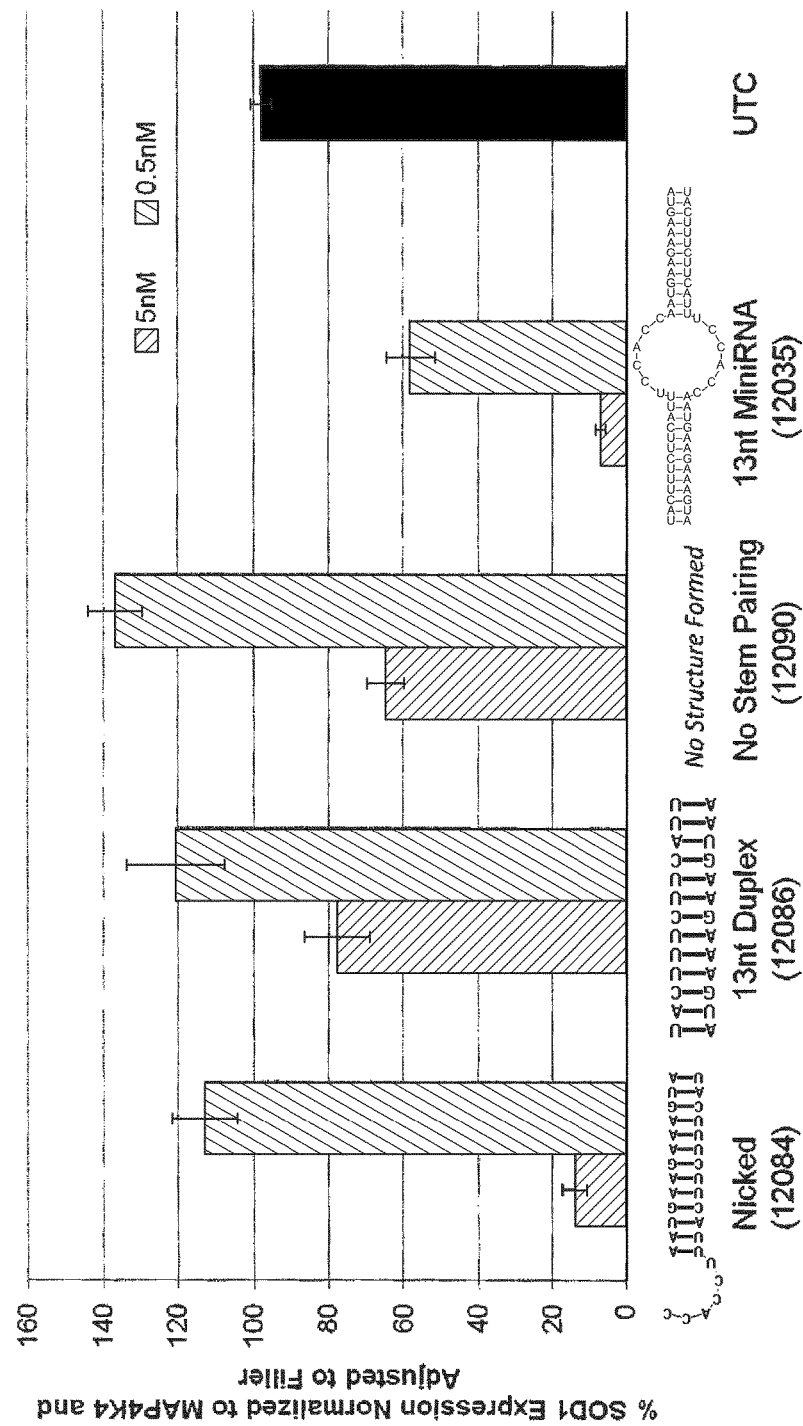
FIG. 18 is a graph showing SOD1 expression following transfection with RNAi constructs associated with the invention. RNAi constructs tested were: 12084 (Nicked), 12086 (13nt Duplex), 12090 (No Stem Pairing) and 12035 (13nt MiniRNA). Results of transfection were compared to an untransfected control sample. The 12084 RNAi construct corresponds to SEQ ID NOs:612 and 613. The 12086 RNAi construct corresponds to SEQ ID NOs:608 and 609. The 12035 RNAi construct corresponds to SEQ ID NOs:610 and 611.
Figure 19:
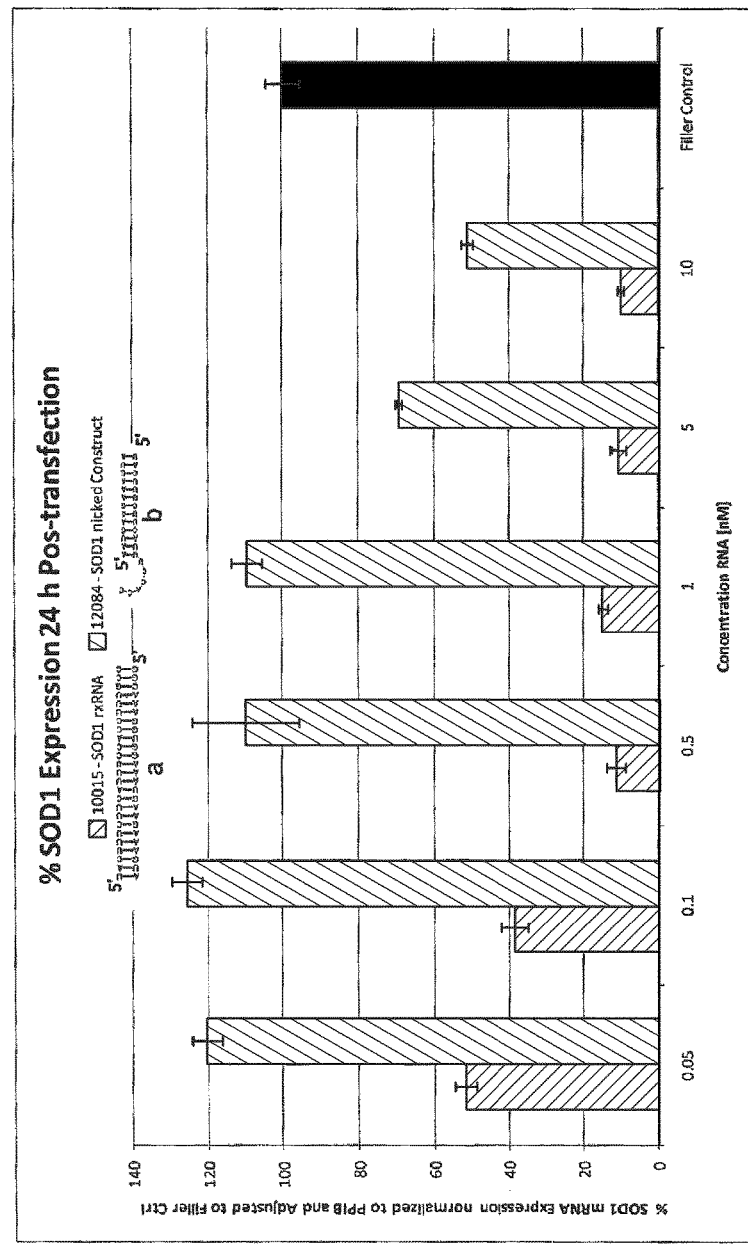
FIG. 19 is a graph showing expression of SOD1 24 hours post-transfection with RNAi constructs associated with the invention. RNAi constructs tested were: 10015 (SOD1 rxRNA) and 12084 (SOD1 Nicked Construct). Results of transfection were compared to a filler control sample. The 10015 RNAi construct corresponds to SEQ ID NOs:614 and 615. The 12084 RNAi construct corresponds to SEQ ID NOs:612 and 613.
Figure 20:
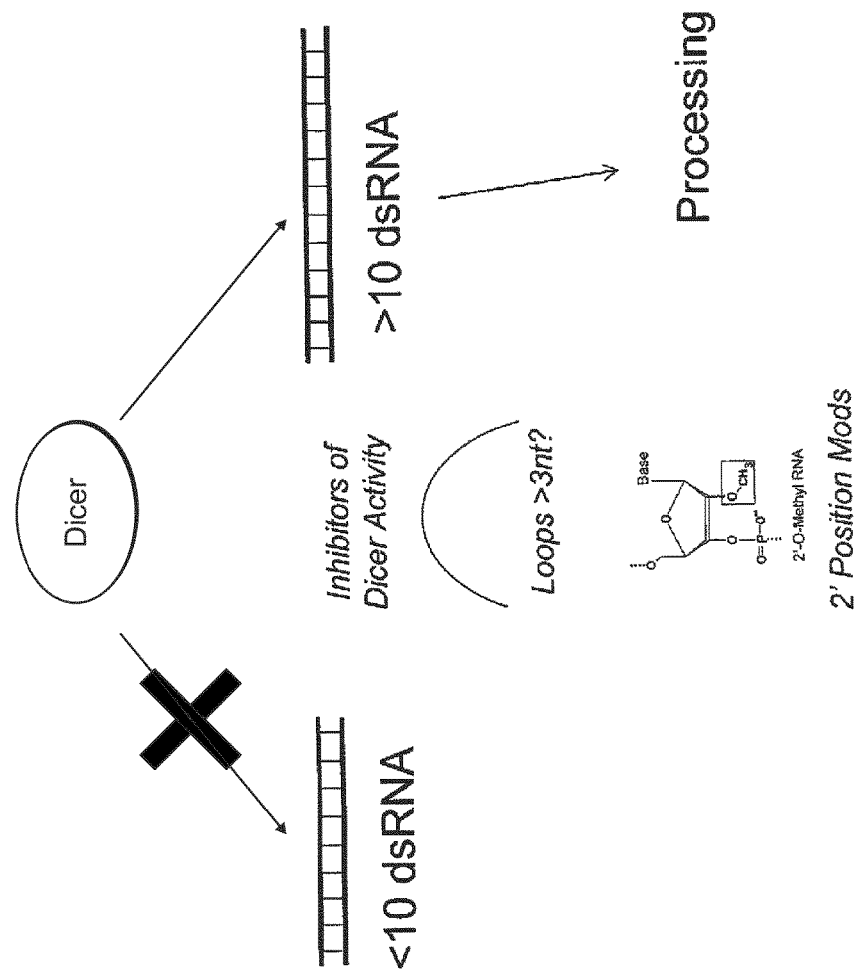
FIG. 20 is a schematic indicating that RNA molecules with double stranded regions that are less than 10 nucleotides are not cleaved by Dicer.
Figure 21:
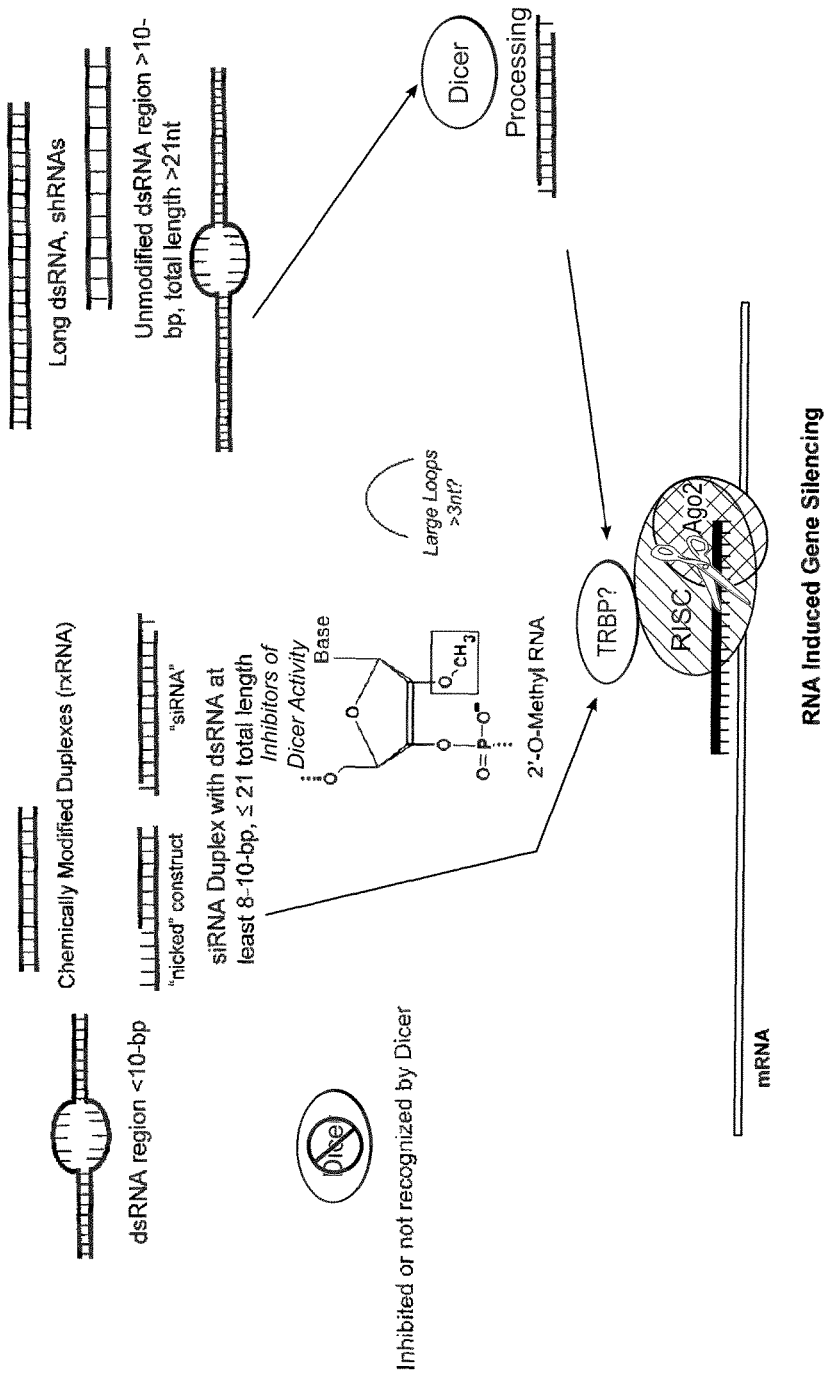
FIG. 21 is a schematic revealing a hypothetical RNAi model for RNA induced gene silencing.

FIG. 13 depicts examples of RNAi constructs and controls designed to target MAP4K4 expression. FIGS. 14 and 15 reveal that RNAi constructs with minimal duplex regions (such as duplex regions of approximately 13 nucleotides) are effective in mediating RNA silencing in cell culture. Parameters associated with these RNA molecules are shown in FIG. 16. FIG. 17 depicts examples of RNAi constructs and controls designed to target SOD1 expression. FIGS. 18 and 19 reveal the results of gene silencing experiments using these RNAi molecules to target SOD1 in cells. FIG. 20 presents a schematic indicating that RNA molecules with double stranded regions that are less than 10 nucleotides are not cleaved by Dicer, and FIG. 21 presents a schematic of a hypothetical RNAi model for RNA induced gene silencing.

The RNA molecules described herein were subject to a variety of chemical modifications on the sense and antisense strands, and the effects of such modifications were observed. RNAi molecules were synthesized and optimized through testing of a variety of modifications. In first generation optimization, the sense (passenger) and anti-sense (guide)

strands of the sd-rxRNA$^{nano}$ molecules were modified for example through incorporation of C and U 2'OMe modifications, 2'F modifications, phosphorothioate modifications, phosphorylation, and conjugation of cholesterol. Molecules were tested for inhibition of MAP4K4 expression in cells including HeLa, primary mouse hepatocytes and primary human hepatocytes through both lipid-mediated and passive uptake transfection.

Figure 22:
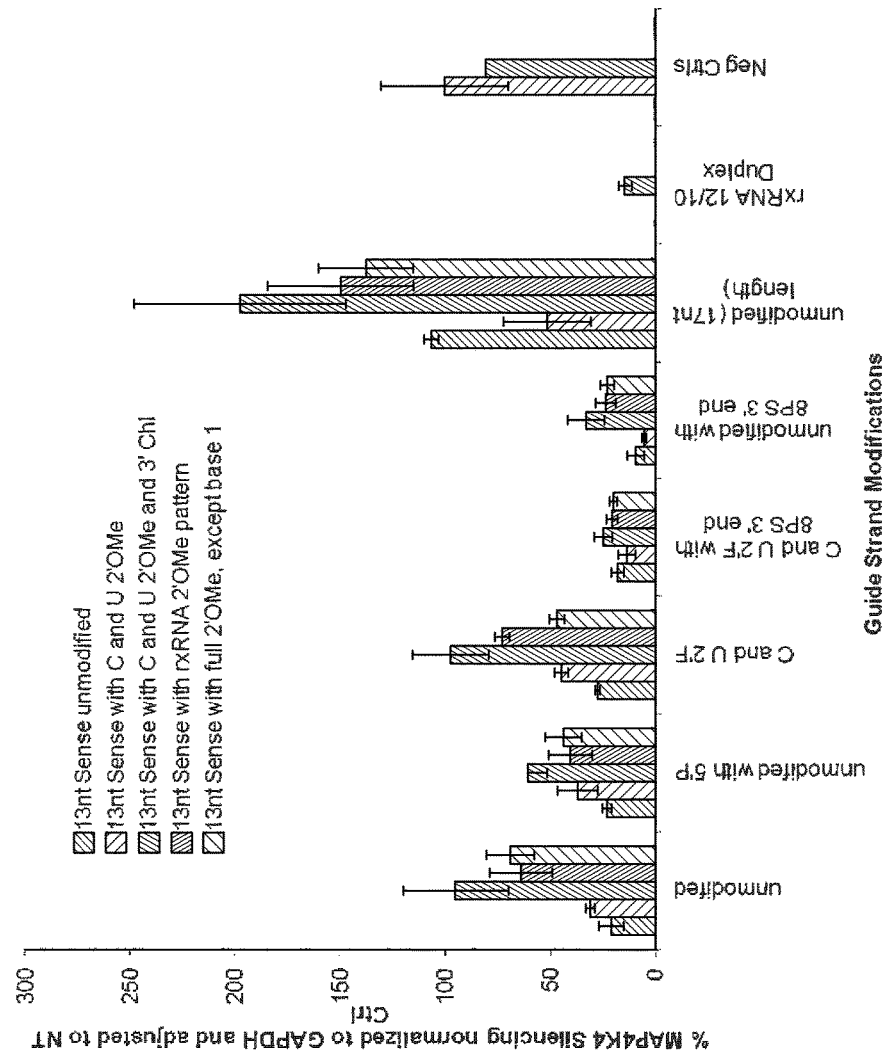
FIG. 22 is a graph showing chemical optimization of asymmetric RNAi compounds. The presence of chemical modifications, in particular 2'F UC, phosphorothioate modifications on the guide strand, and complete CU 2'OMe modification of the passenger strands results in development of functional compounds. Silencing of MAP4K4 following lipid-mediated transfection is shown using RNAi molecules with specific modifications. RNAi molecules tested had sense strands that were 13 nucleotides long and contained the following modifications: unmodified; C and U 2'OMe; C and U 2'OMe and 3' Chl; rxRNA 2'OMe pattern; or full 2'OMe, except base 1. Additionally, the guide (anti-sense) strands of the RNAi molecules tested contained the following modifications: unmodified; unmodified with 5'P; C and U 2'F; C and U 2'F with 8 PS 3' end; and unmodified (17 nt length). Results for rxRNA 12/10 Duplex and negative controls are also shown.
Figure 24:
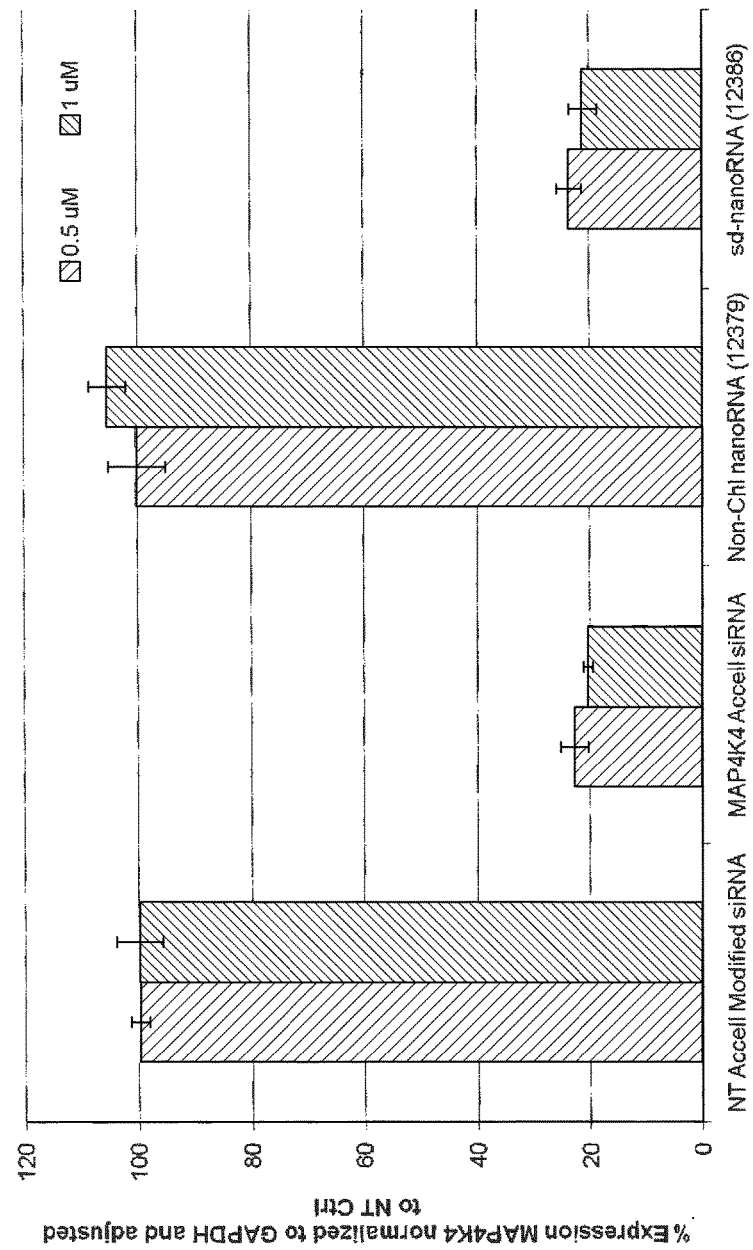
FIG. 24 is a graph showing MAP4K4 expression in Hela cells following passive uptake transfection of: NT Accell modified siRNA, MAP4K4 Accell siRNA, Non-Chl nanoRNA (12379) and sd-nanoRNA (12386).

FIG. 22 reveals that chemical modifications can enhance gene silencing. In particular, modifying the guide strand with 2'F UC modifications, and with a stretch of phosphorothioate modifications, combined with complete CU O'Me modification of the passenger strands, resulted in molecules that were highly effective in gene silencing. The effect of chemical modification on in vitro efficacy in un-assisted delivery in HeLa cells was also examined FIG. 23 reveals that compounds lacking any of 2'F, 2'OMe, a stretch of phosphorothioate modifications, or cholesterol conjugates, were completely inactive in passive uptake. A combination of all 4 types of chemical modifications, for example in compound 12386, was found to be highly effective in gene silencing. FIG. 24 also shows the effectiveness of compound 12386 in gene silencing.

Figure 25:
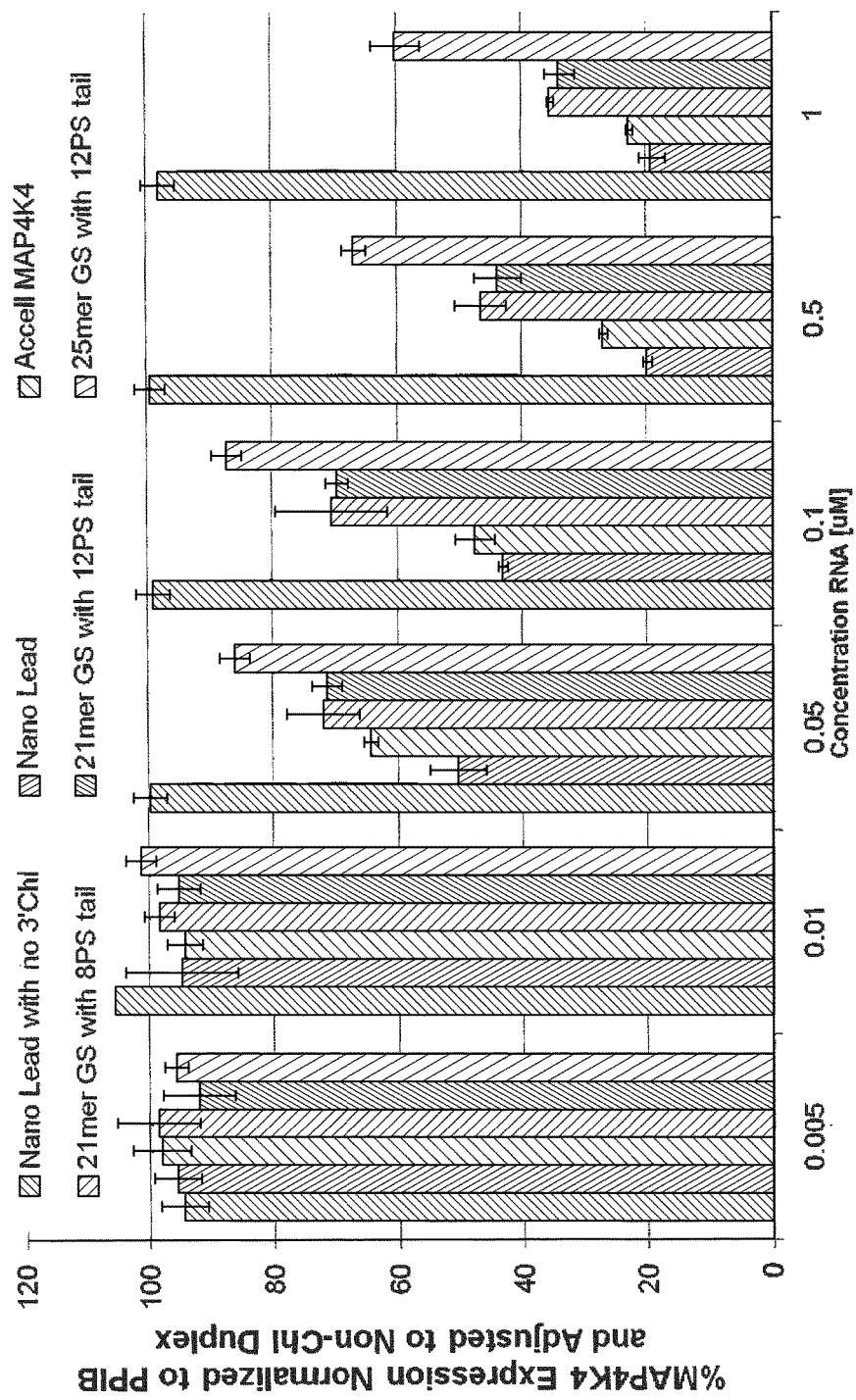
FIG. 25 is a graph showing expression of MAP4K4 in HeLa cells following passive uptake transfection of various concentrations of RNA molecules containing the following parameters: Nano Lead with no 3'Chl; Nano Lead; Accell MAP4K4; 21mer GS with 8 PS tail; 21mer GS with 12 PS tail; and 25mer GS with 12 PS tail.
Figure 88:
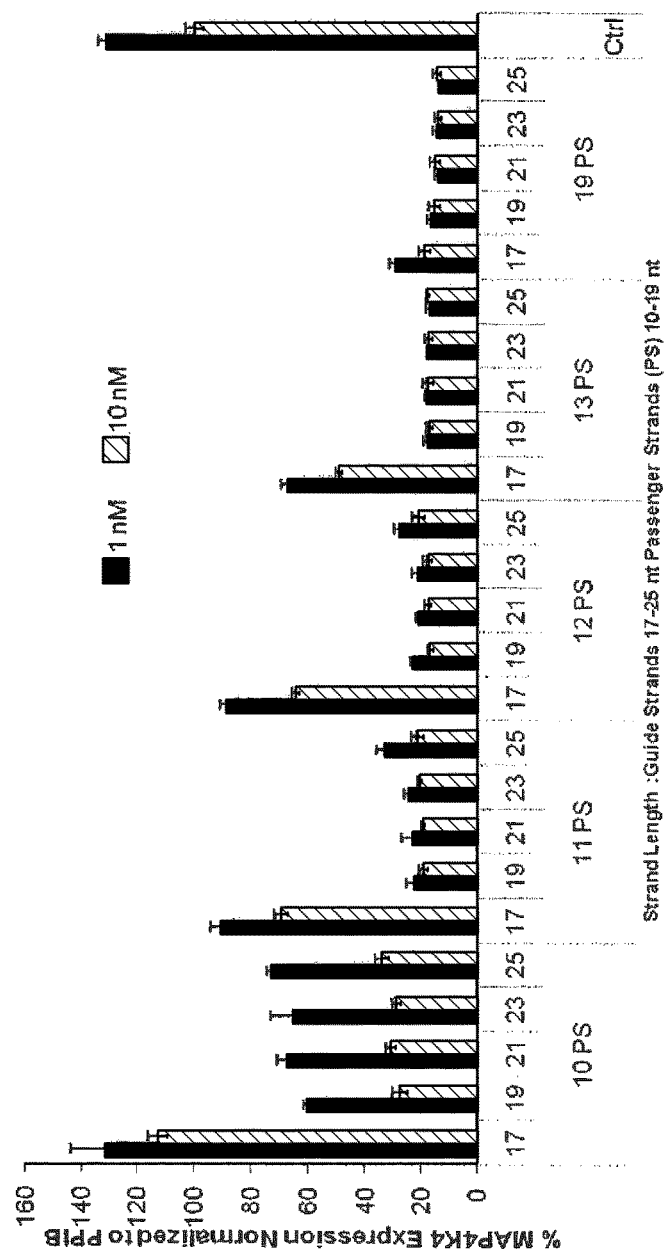
FIG. 88 demonstrates a systematic screen identifying the minimal length of the asymmetric compounds. The passenger strand of 10-19 bases was hybridized to a guide strand of 17-25 bases. In this assay, compounds with duplex regions as short as 10 bases were found to be effective in inducing.
Figure 89:
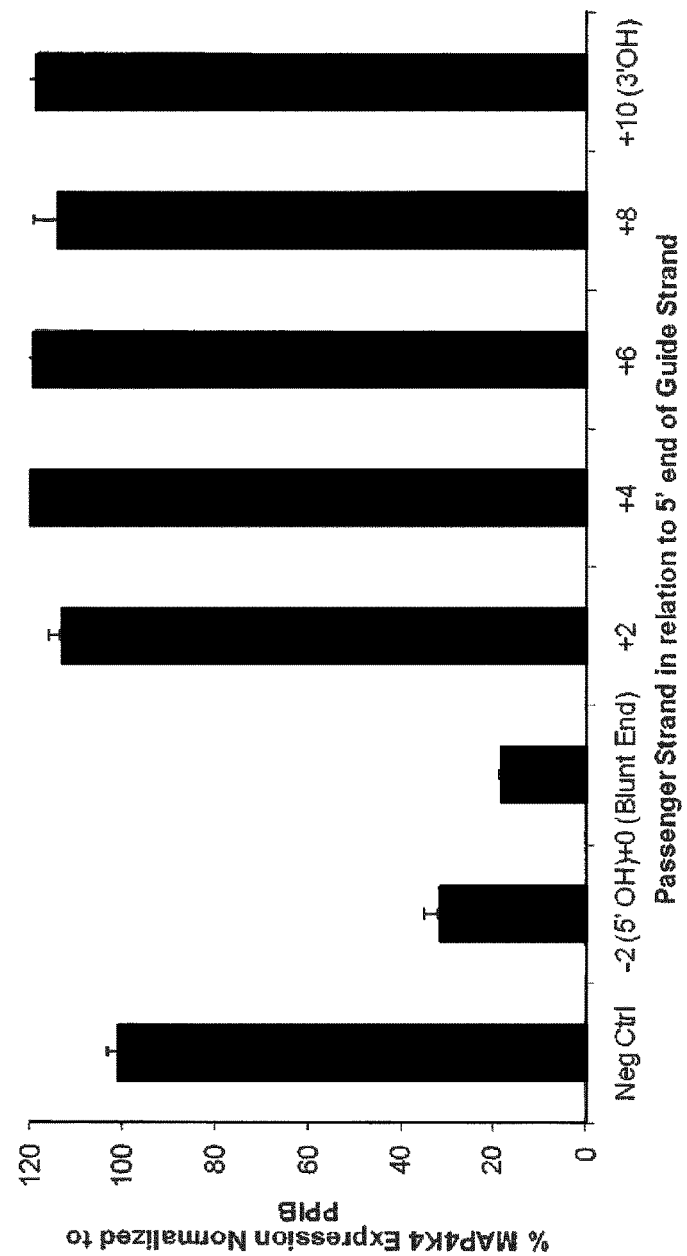
FIG. 89 demonstrates that positioning of the sense strand relative to the guide strand is critical for RNAi Activity. In this assay, a blunt end was found to be optimal, a 3' overhang was tolerated, and a 5' overhang resulted in complete loss of functionality.
Figure 90:
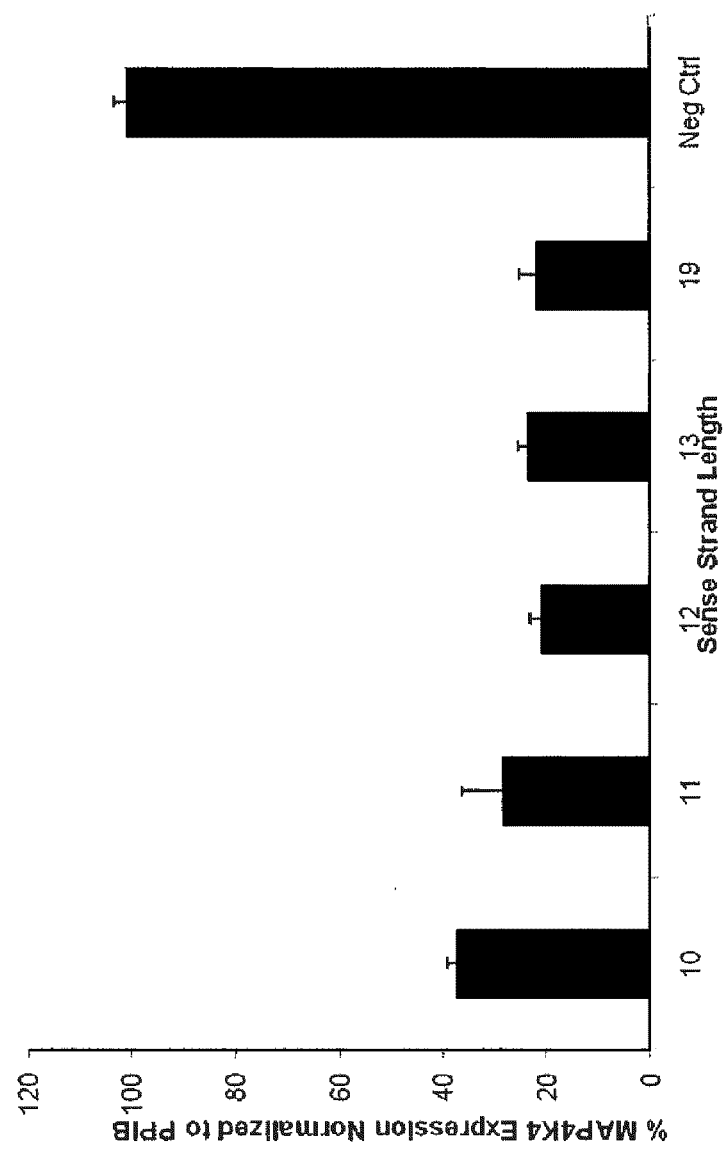
FIG. 90 demonstrates that the guide strand, which has homology to the target only at nucleotides 2-17, resulted in effective RNAi when hybridized with sense strands of different lengths. The compounds were introduced into HeLa cells via lipid mediated transfection.

Optimization of the length of the oligonucleotide was also investigated. FIGS. 25 and 26 reveal that oligonucleotides with a length of 21 nucleotides were more effective than oligonucleotides with a length of 25 nucleotides, indicating that reduction in the size of an RNA molecule can improve efficiency, potentially by assisting in its uptake. Screening was also conducted to optimize the size of the duplex region of double stranded RNA molecules. FIG. 88 reveals that compounds with duplexes of 10 nucleotides were effective in inducing gene silencing. Positioning of the sense strand relative to the guide strand can also be critical for silencing gene expression (FIG. 89). In this assay, a blunt end was found to be most effective. 3' overhangs were tolerated, but 5' overhangs resulted in a complete loss of functionality. The guide strand can be effective in gene silencing when hybridized to a sense strand of varying lengths (FIG. 90). In this assay presented in FIG. 90, the compounds were introduced into HeLa cells via lipid mediated transfection.

The importance of phosphorothioate content of the RNA molecule for unassisted delivery was also investigated. FIG. 27 presents the results of a systematic screen that identified that the presence of at least 2-12 phosphorothioates in the guide strand as being highly advantageous for achieving uptake, with 4-8 being the preferred number. FIG. 27 also shows that presence or absence of phosphorothioate modifications in the sense strand did not alter efficacy.

Figure 28:
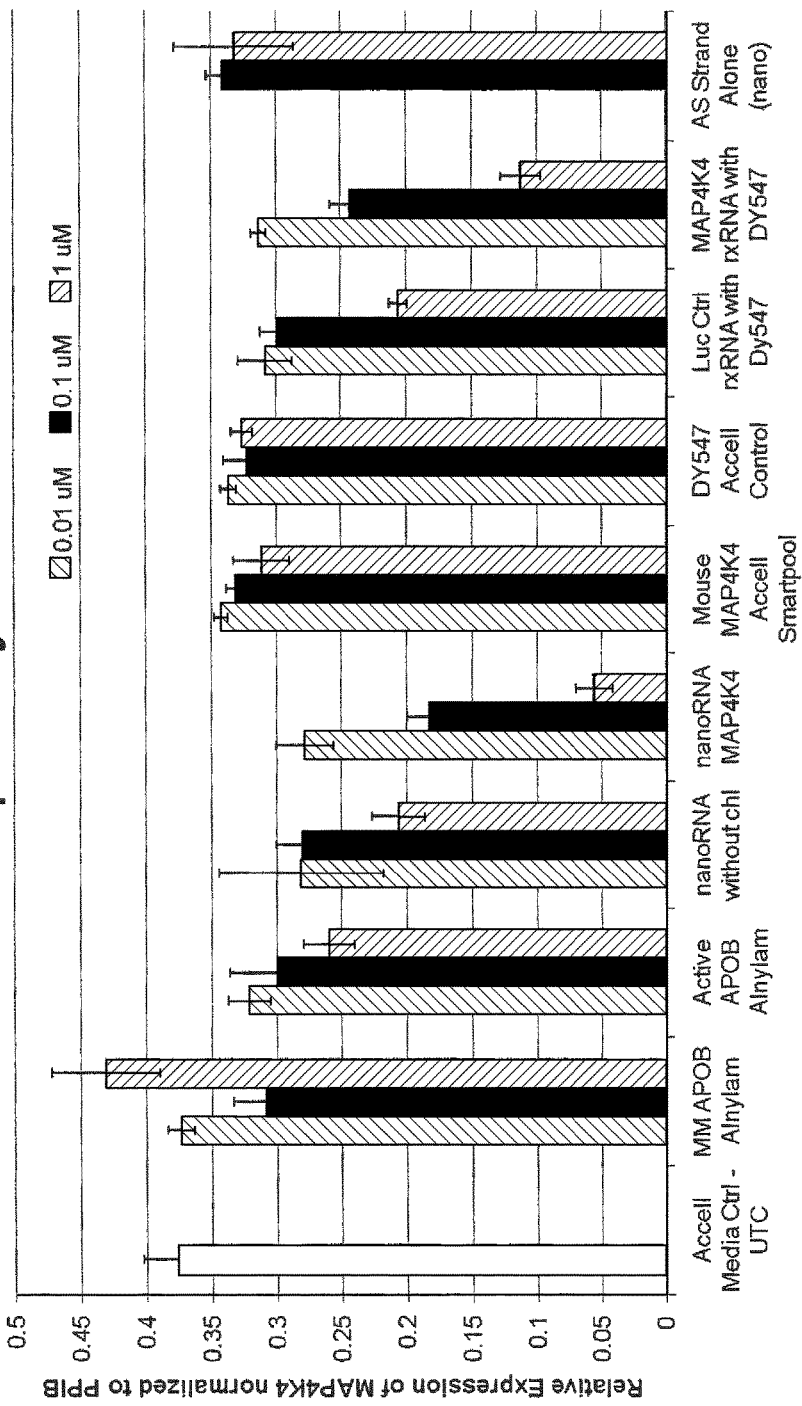
FIG. 28 is a graph showing expression of MAP4K4 in primary mouse hepatocytes following passive uptake transfection of: Accell Media-Ctrl-UTC; MM APOB Alnylam; Active APOB Alnylam; nanoRNA without chl; nanoRNA MAP4K4; Mouse MAP4K4 Accell Smartpool; DY547 Accell Control; Luc Ctrl rxRNA with Dy547; MAP4K4 rxRNA with DY547; and AS Strand Alone (nano).
Figure 29:
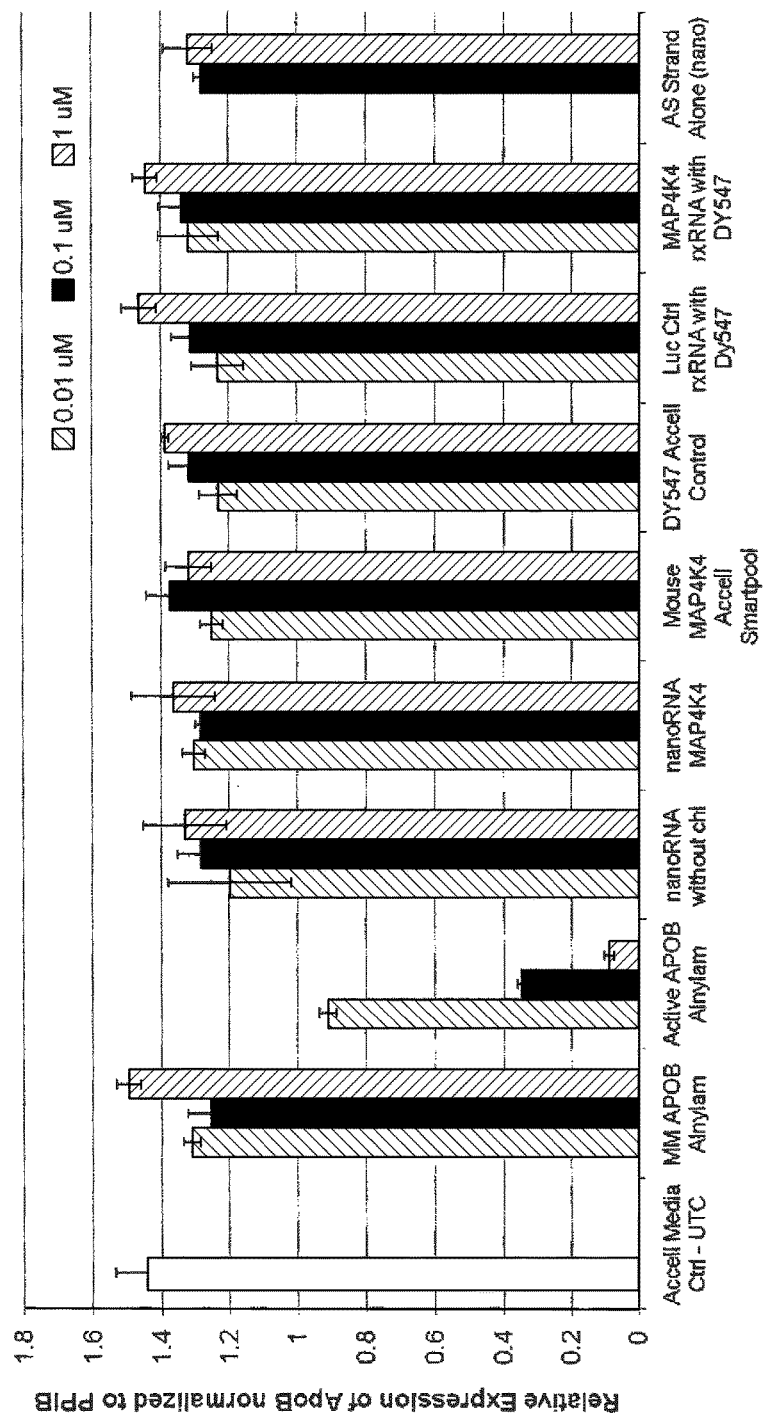
FIG. 29 is a graph showing expression of ApoB in mouse primary hepatocytes following passive uptake transfection of: Accell Media-Ctrl-UTC; MM APOB Alnylam; Active APOB Alnylam; nanoRNA without chl; nanoRNA MAP4K4; Mouse MAP4K4 Accell Smartpool; DY547 Accell Control; Luc Ctrl rxRNA with Dy547; MAP4K4 rxRNA with DY547; and AS Strand Alone (nano).
Figure 30:
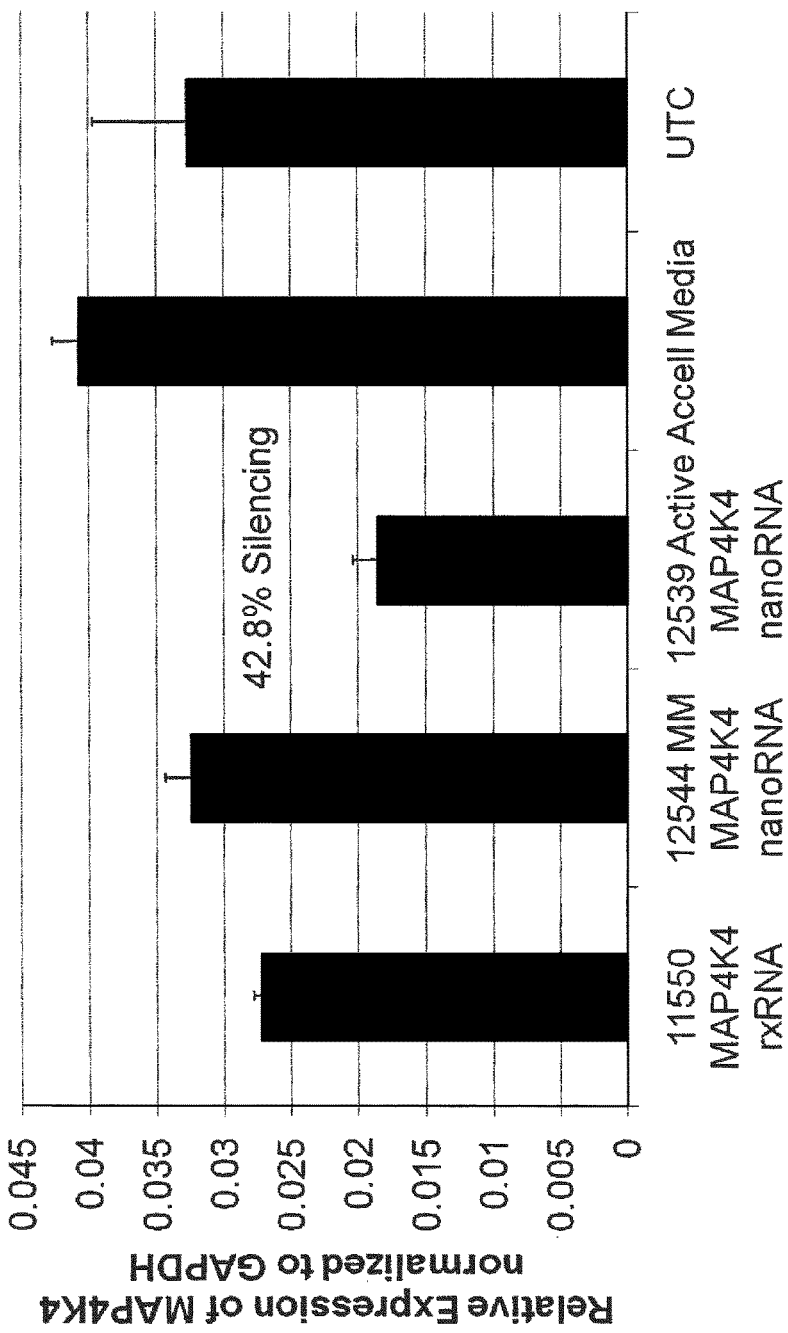
FIG. 30 is a graph showing expression of MAP4K4 in primary human hepatocytes following passive uptake transfection of: 11550 MAP4K4 rxRNA; 12544 MM MAP4K4 nanoRNA; 12539 Active MAP4K4 nanoRNA; Accell Media; and UTC.
Figure 31:
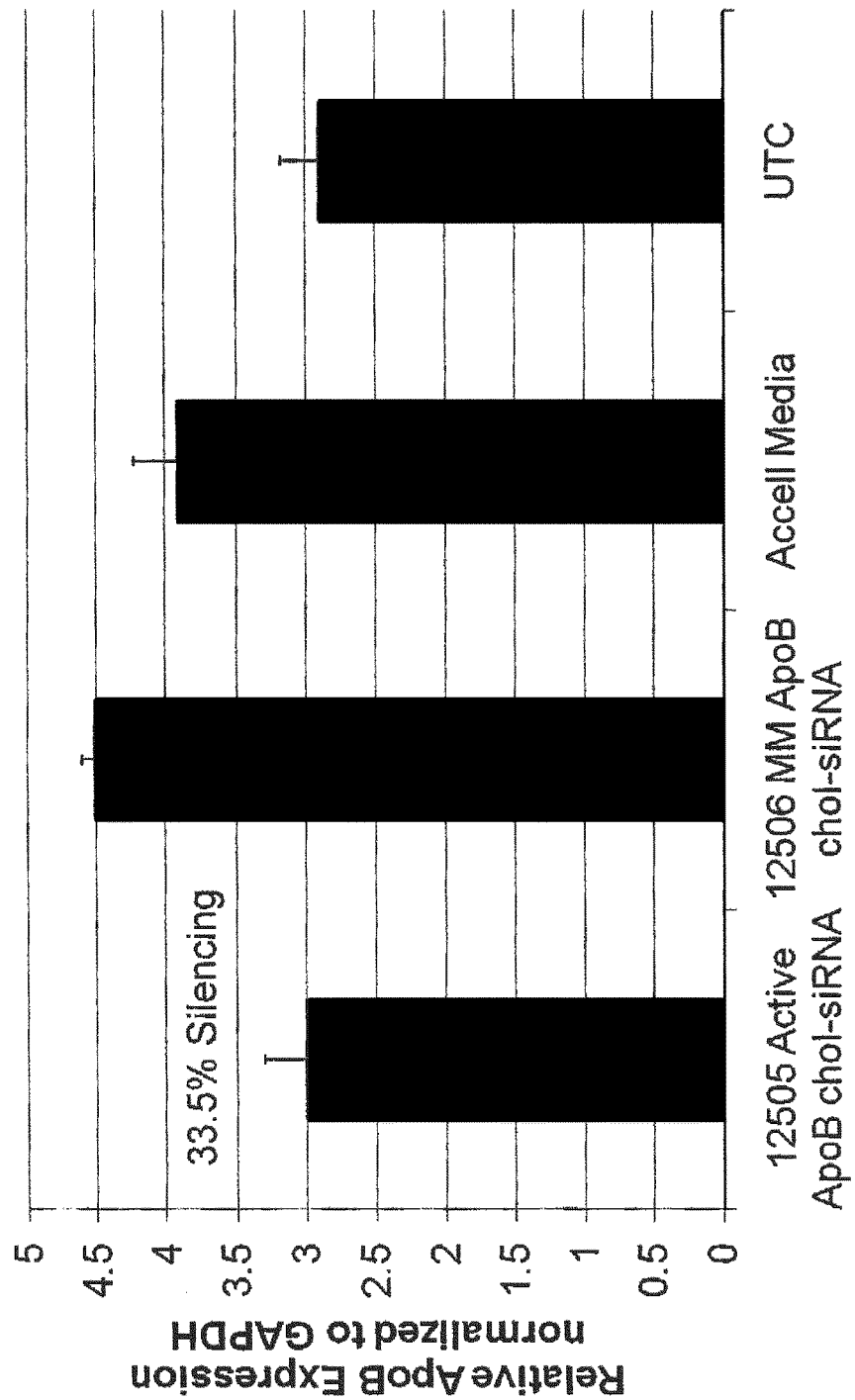
FIG. 31 is a graph showing ApoB expression in primary human hepatocytes following passive uptake transfection of: 12505 Active ApoB chol-siRNA; 12506 mM ApoB chol-siRNA; Accell Media; and UTC.
Figure 32:
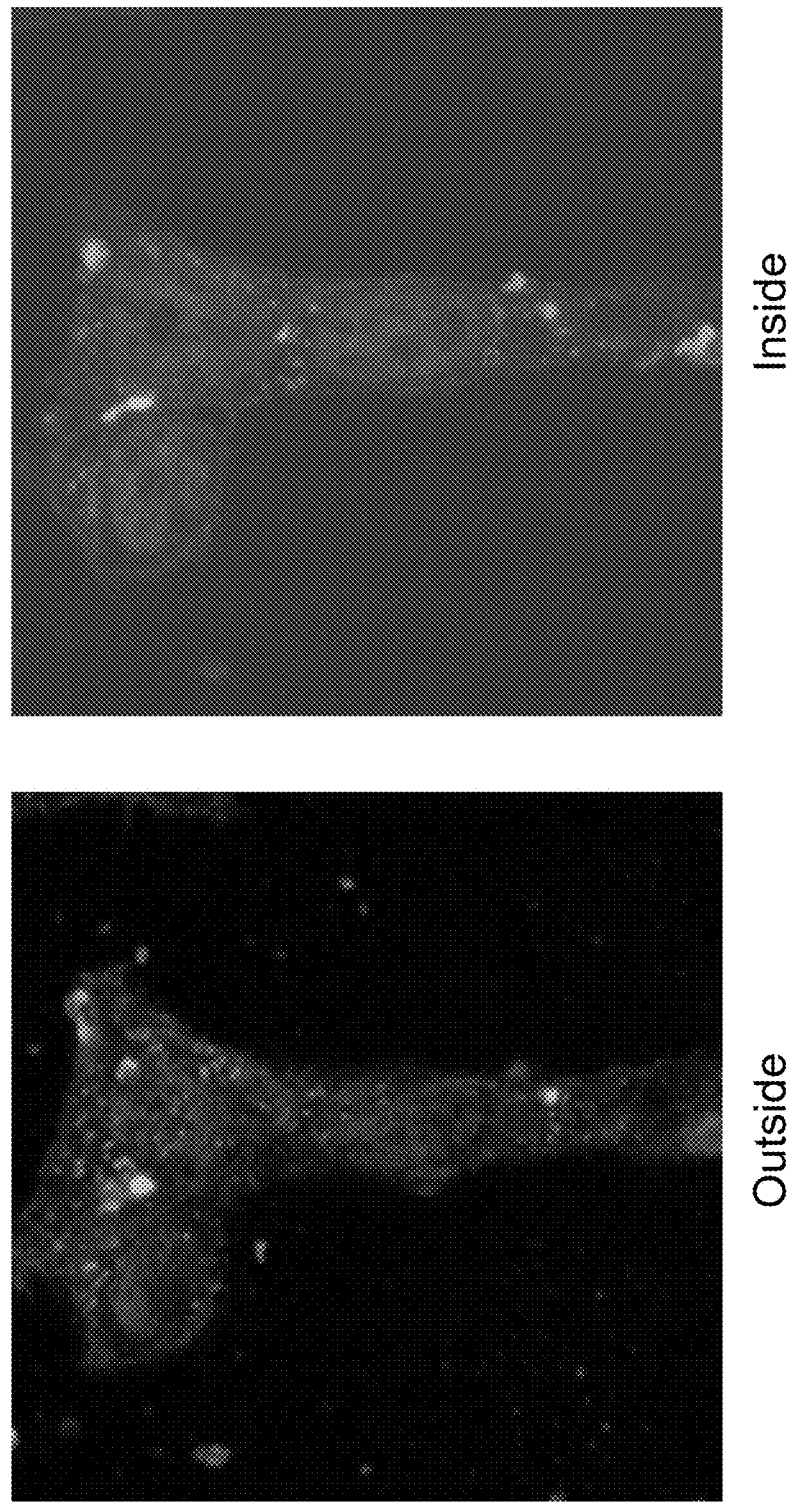
FIG. 32 is an image depicting localization of sd-rxRNA$^{nano}$ localization.
Figure 33:
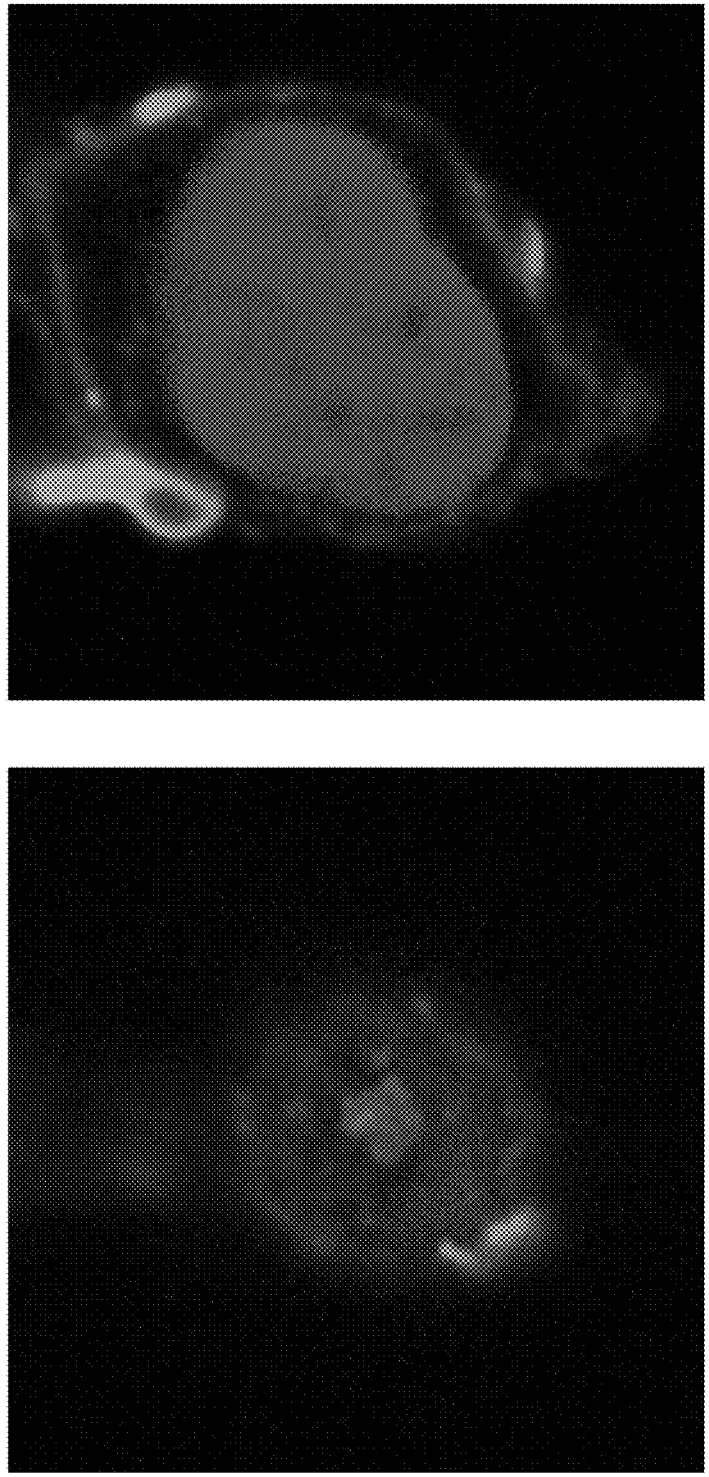
FIG. 33 is an image depicting localization of Chol-siRNA (Alnylam).
Figure 34:
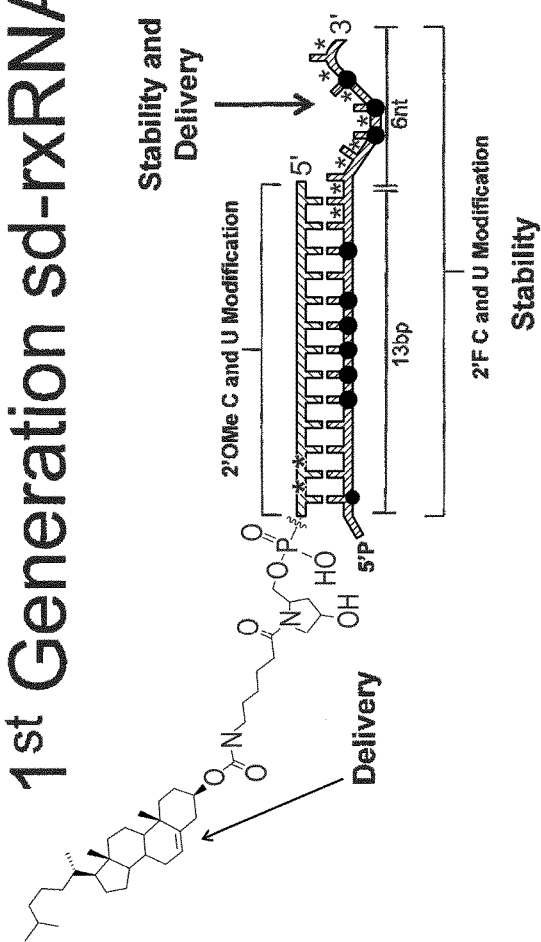
FIG. 34 is a schematic of 1$^{st}$ generation (G1) sd-rxRNA$^{nano}$ molecules associated with the invention indicating regions that are targeted for modification, and functions associated with different regions of the molecules.

FIGS. 28-29 reveal the effects of passive uptake of RNA compounds on gene silencing in primary mouse hepatocytes. nanoRNA molecules were found to be highly effective, especially at a concentration of 1 µM (FIG. 28). FIGS. 30 and 31 reveal that the RNA compounds associated with the invention were also effective in gene silencing following passive uptake in primary human hepatocytes. The cellular localization of the RNA molecules associated with the invention was examined and compared to the localization of Chol-siRNA (Alnylam) molecules, as shown in FIGS. 32 and 33.

Figure 35:
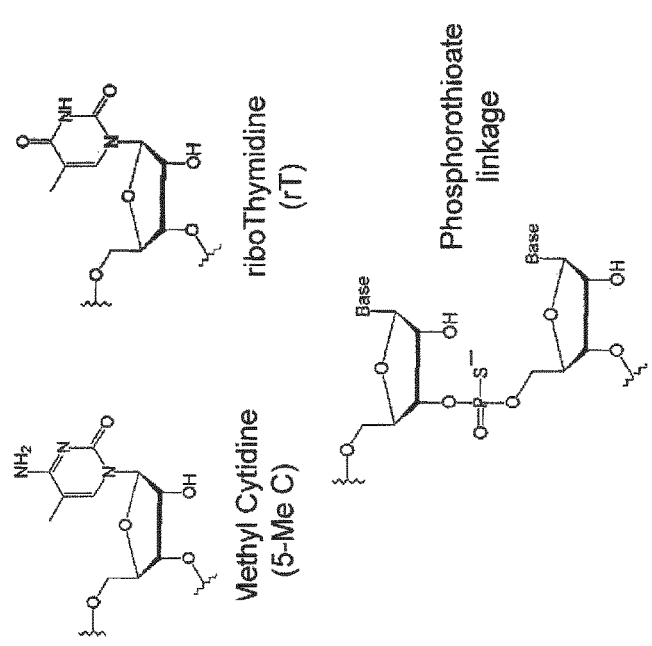
FIG. 35 depicts modification patterns that were screened for optimization of sd-rxRNA$^{nano}$ (G1). The modifications that were screened included, on the guide strand, lengths of 19, 21 and 25 nucleotides, phosphorothioate modifications of 0-18 nucleotides, and replacement of 2'F modifications with 2'OMe, 5 Methyl C and/or ribo Thymidine modifications. Modifications on the sense strand that were screened included nucleotide lengths of 11, 13 and 19 nucleotides, phosphorothioate modifications of 0-4 nucleotides and 2'OMe modifications.
Figure 36:
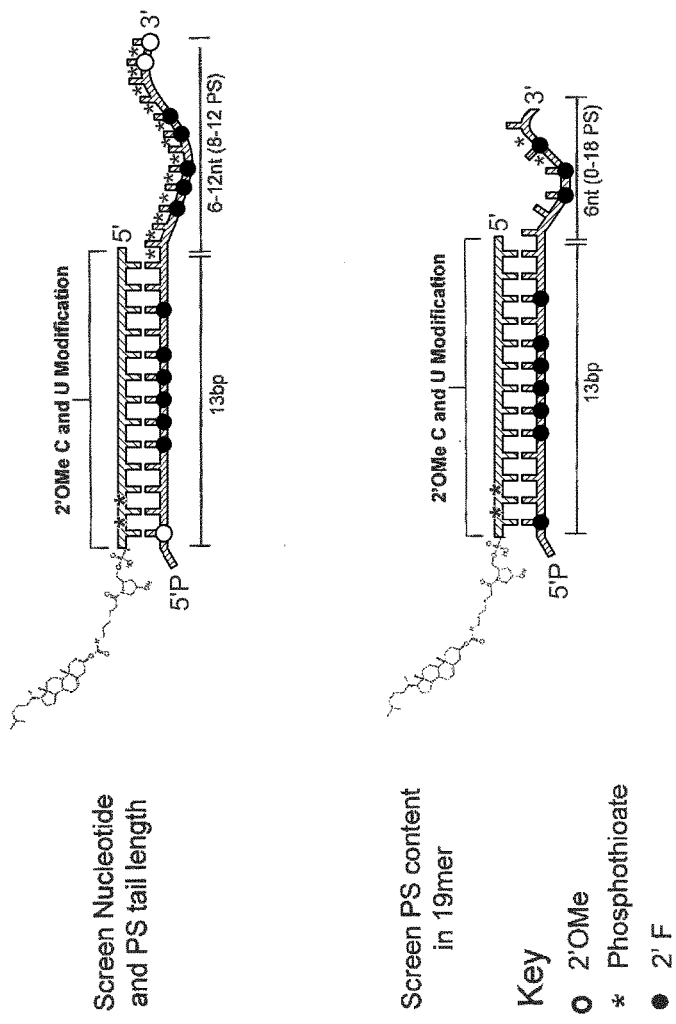
FIG. 36 is a schematic depicting modifications of sd-rxRNA$^{nano}$ that were screened for optimization.
Figure 37:
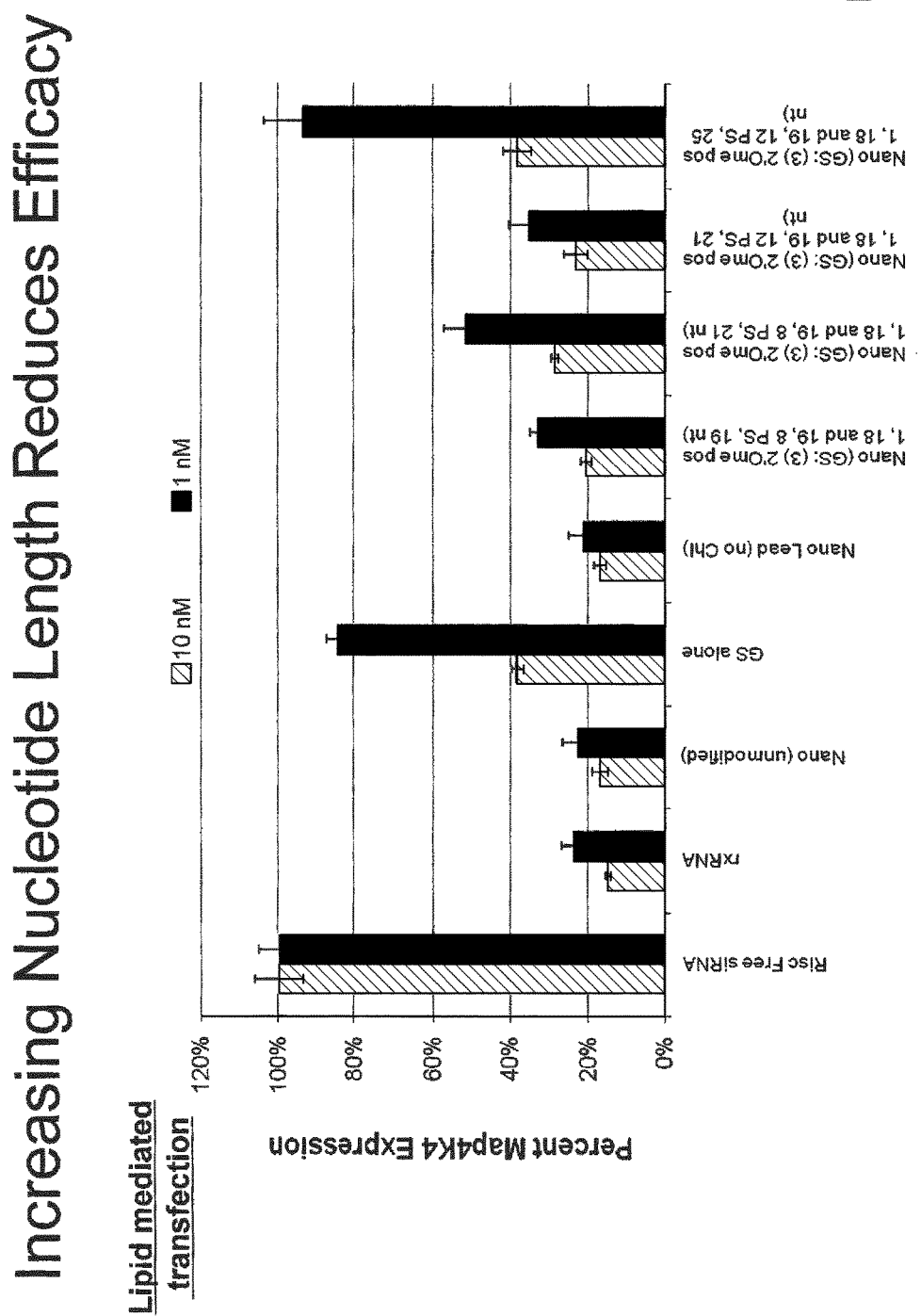
FIG. 37 is a graph showing percent MAP4K4 expression in Hek293 cells following transfection of: Risc Free siRNA; rxRNA; Nano (unmodified); GS alone; Nano Lead (no Chl); Nano (GS: (3) 2'OMe at positions 1, 18, and 19, 8 PS, 19 nt); Nano (GS: (3) 2'OMe at positions 1, 18, and 19, 8 PS, 21 nt); Nano (GS: (3) 2'OMe at positions 1, 18, and 19, 12 PS, 21 nt); and Nano (GS: (3) 2'OMe at positions 1, 18, and 19, 12 PS, 25 nt)
Figure 38:
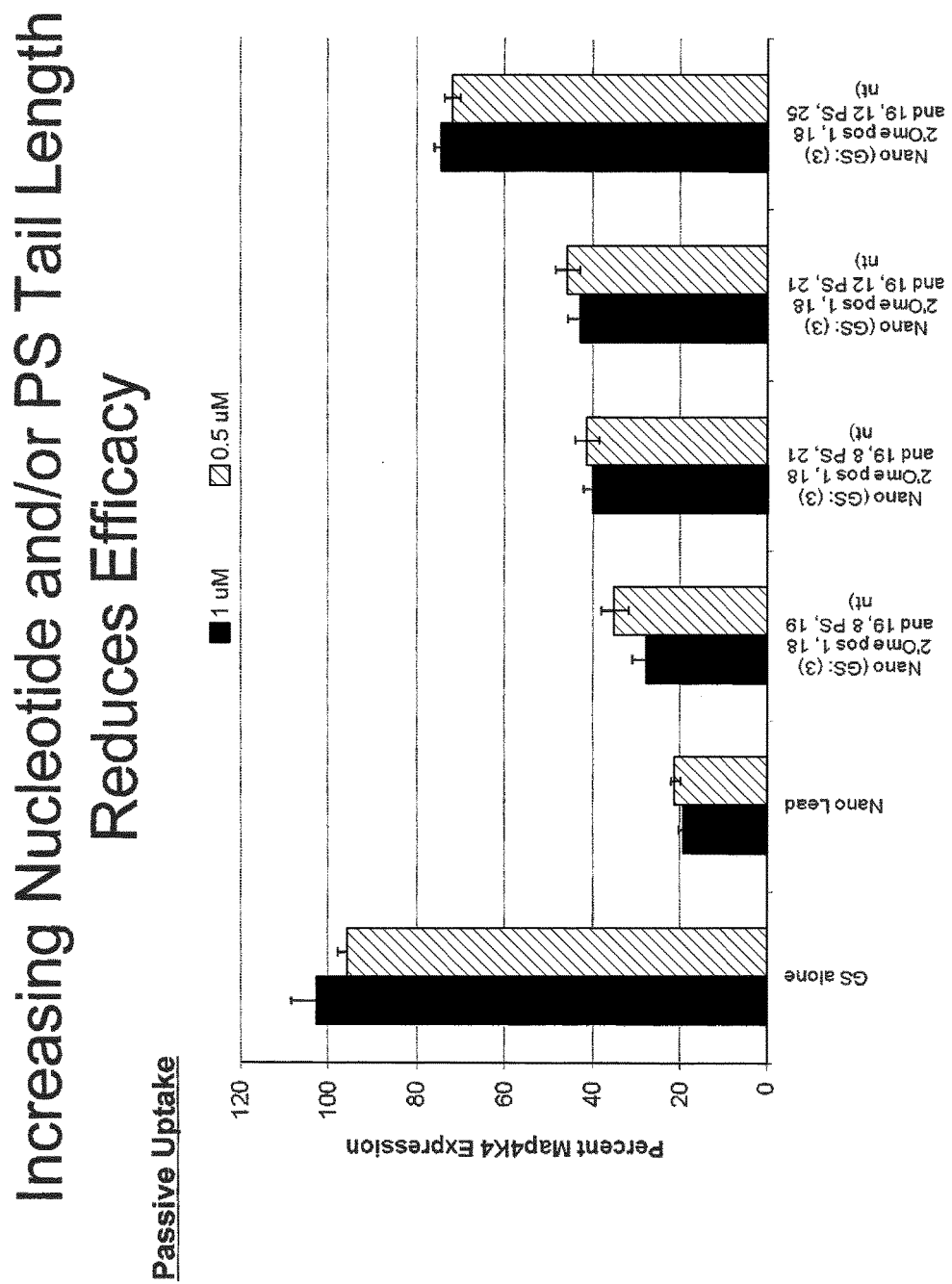
FIG. 38 is a graph showing percent MAP4K4 expression in HeLa cells following passive uptake transfection of: GS alone; Nano Lead; Nano (GS: (3) 2'OMe at positions 1, 18, and 19, 8 PS, 19 nt); Nano (GS: (3) 2'OMe at positions 1, 18, and 19, 8 PS, 21 nt); Nano (GS: (3) 2'OMe at positions 1, 18, and 19, 12 PS, 21 nt); Nano (GS: (3) 2'OMe at positions 1, 18, and 19, 12 PS, 25 nt).
Figure 39:
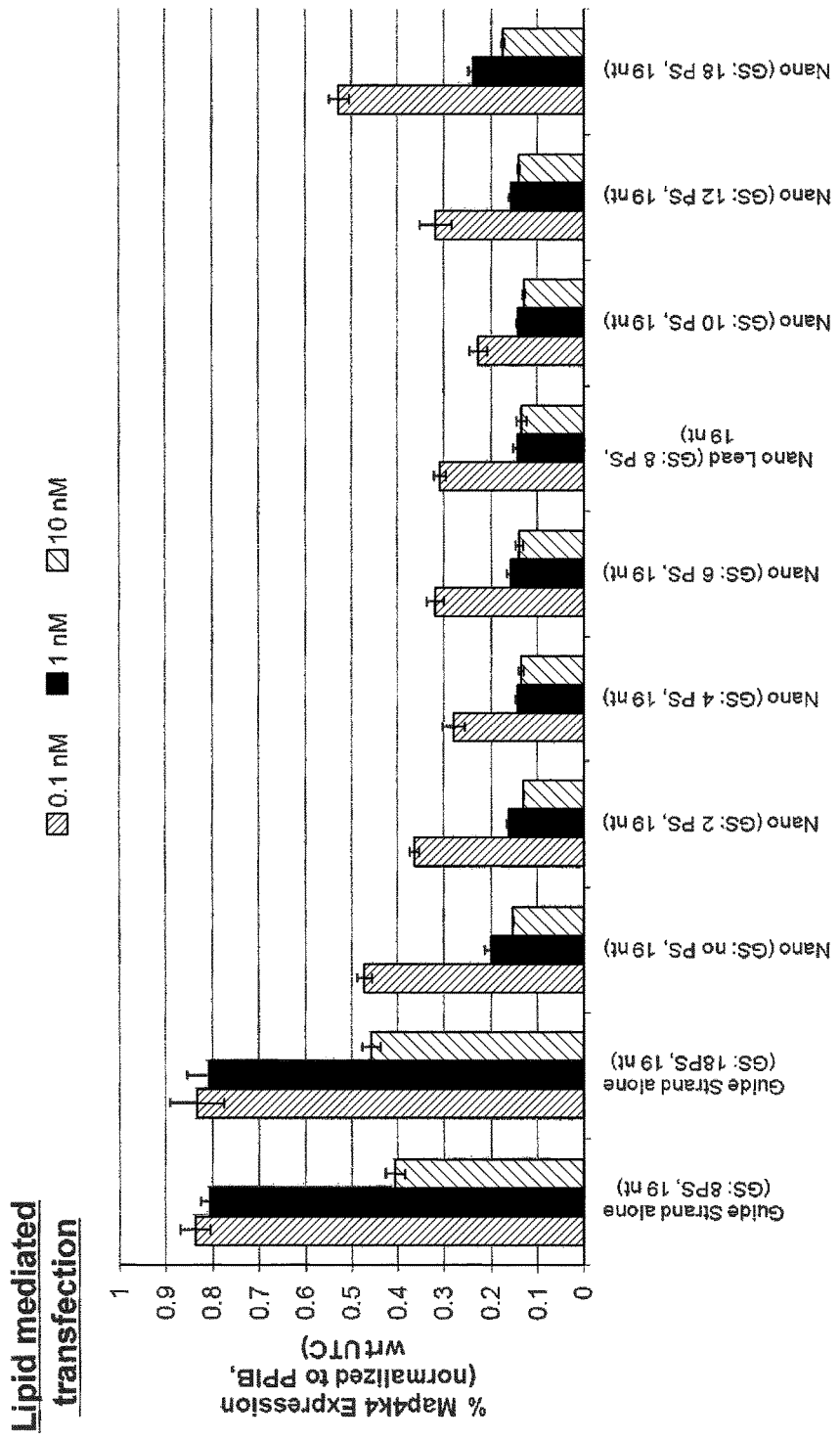
FIG. 39 is a graph showing percent MAP4K4 expression in Hek293 cells following lipid mediated transfection of: Guide Strand alone (GS: 8PS, 19 nt); Guide Strand alone (GS: 18PS, 19 nt); Nano (GS: no PS, 19 nt); Nano (GS: 2 PS, 19 nt); Nano (GS: 4 PS, 19 nt); Nano (GS: 6 PS, 19 nt); Nano Lead (GS: 8 PS, 19 nt); Nano (GS: 10 PS, 19 nt); Nano (GS: 12 PS, 19 nt); and Nano (GS: 18 PS, 19 nt).
Figure 40:
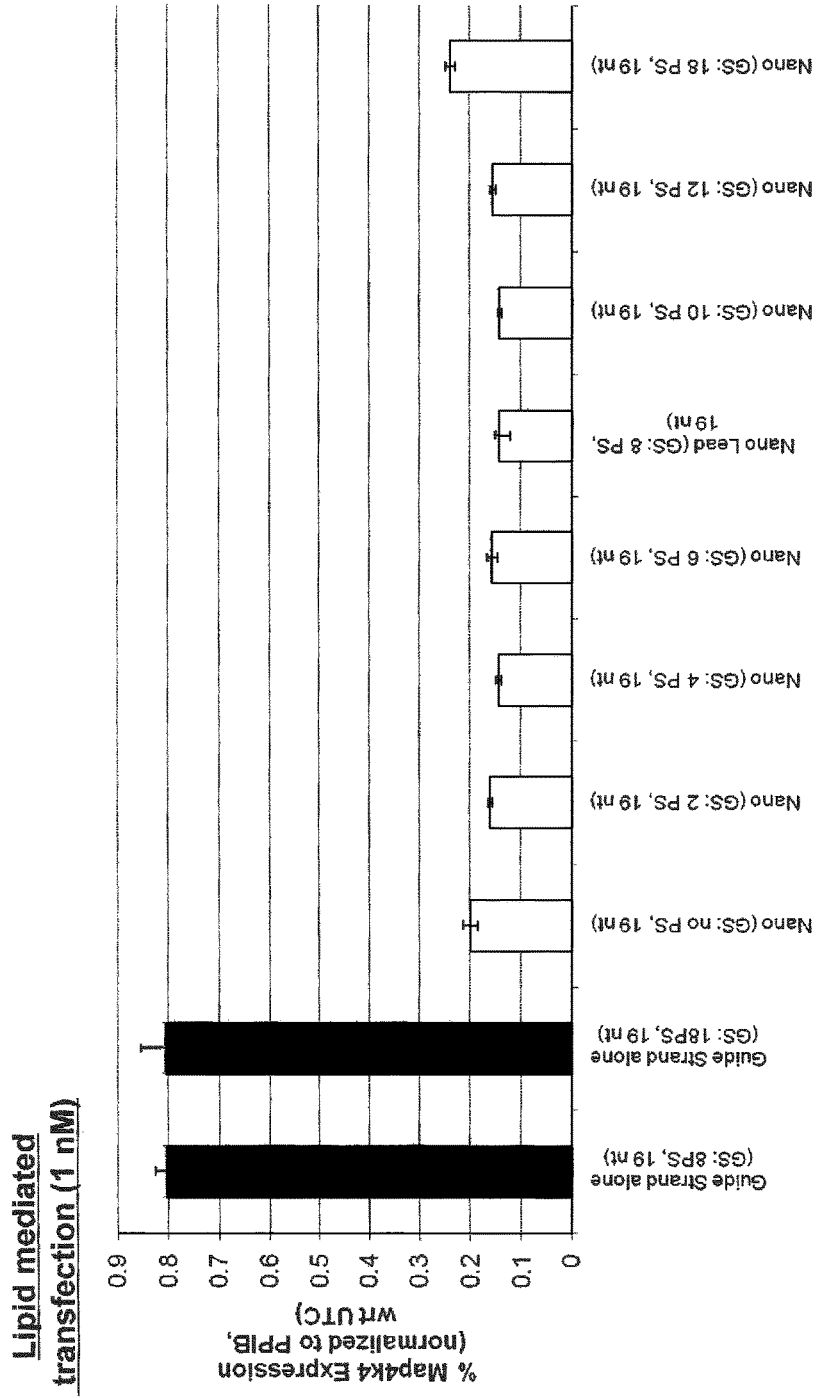
FIG. 40 is a graph showing percent MAP4K4 expression in Hek293 cells following lipid mediated transfection of: Guide Strand alone (GS: 8PS, 19 nt); Guide Strand alone (GS: 18PS, 19 nt); Nano (GS: no PS, 19 nt); Nano (GS: 2 PS, 19 nt); Nano (GS: 4 PS, 19 nt); Nano (GS: 6 PS, 19 nt); Nano Lead (GS: 8 PS, 19 nt); Nano (GS: 10 PS, 19 nt); Nano (GS: 12 PS, 19 nt); and Nano (GS: 18 PS, 19 nt).
Figure 41:
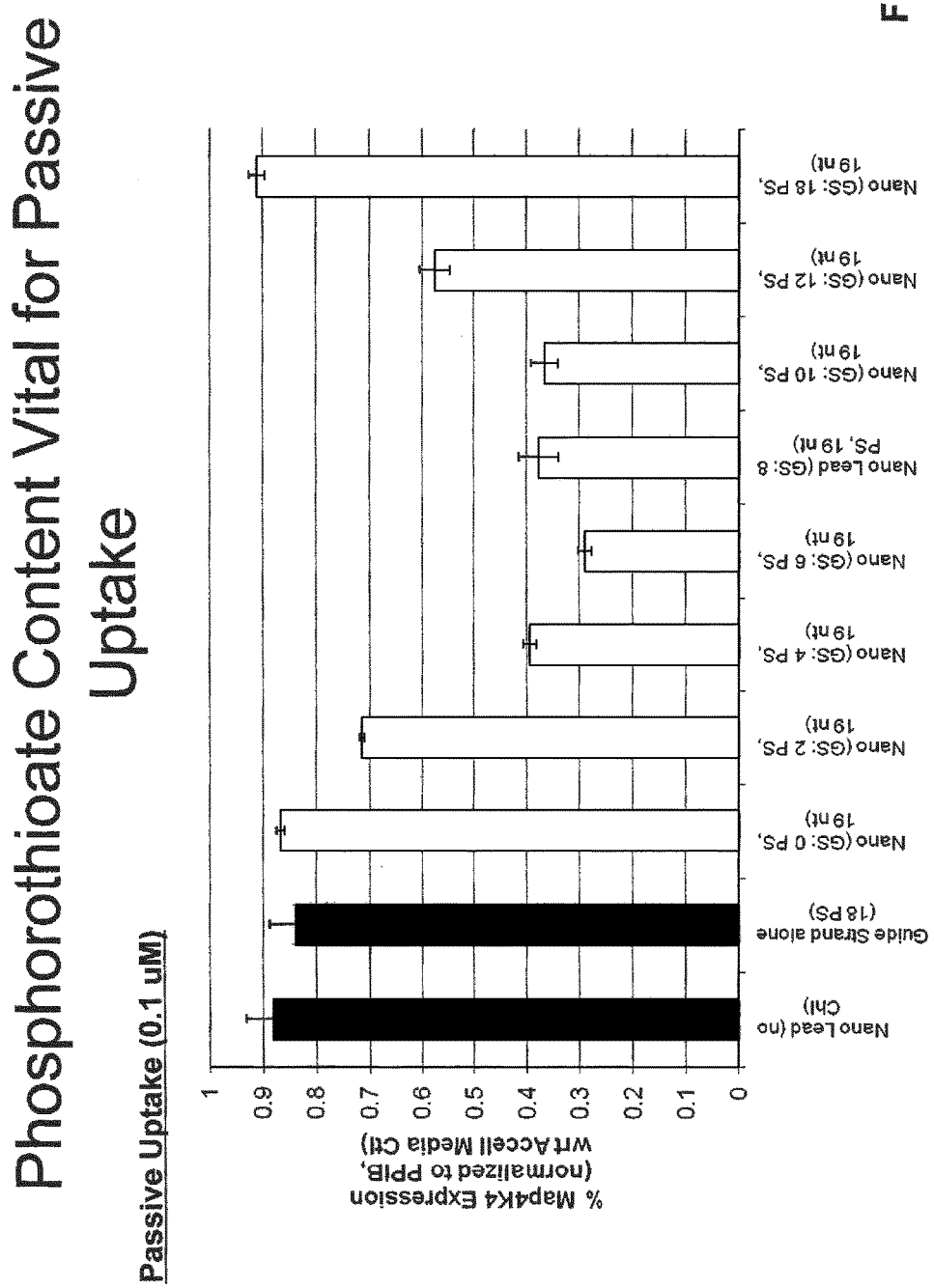
FIG. 41 is a graph showing percent MAP4K4 expression in HeLa cells following passive uptake transfection of: Nano Lead (no Chl); Guide Strand alone (18 PS); Nano (GS: 0 PS, 19 nt); Nano (GS: 2 PS, 19 nt); Nano (GS: 4 PS, 19 nt); Nano (GS: 6 PS, 19 nt); Nano Lead (GS: 8 PS, 19 nt); Nano (GS: 10 PS, 19 nt); Nano (GS: 12 PS, 19 nt); and Nano (GS: 18 PS, 19 nt).
Figure 42:
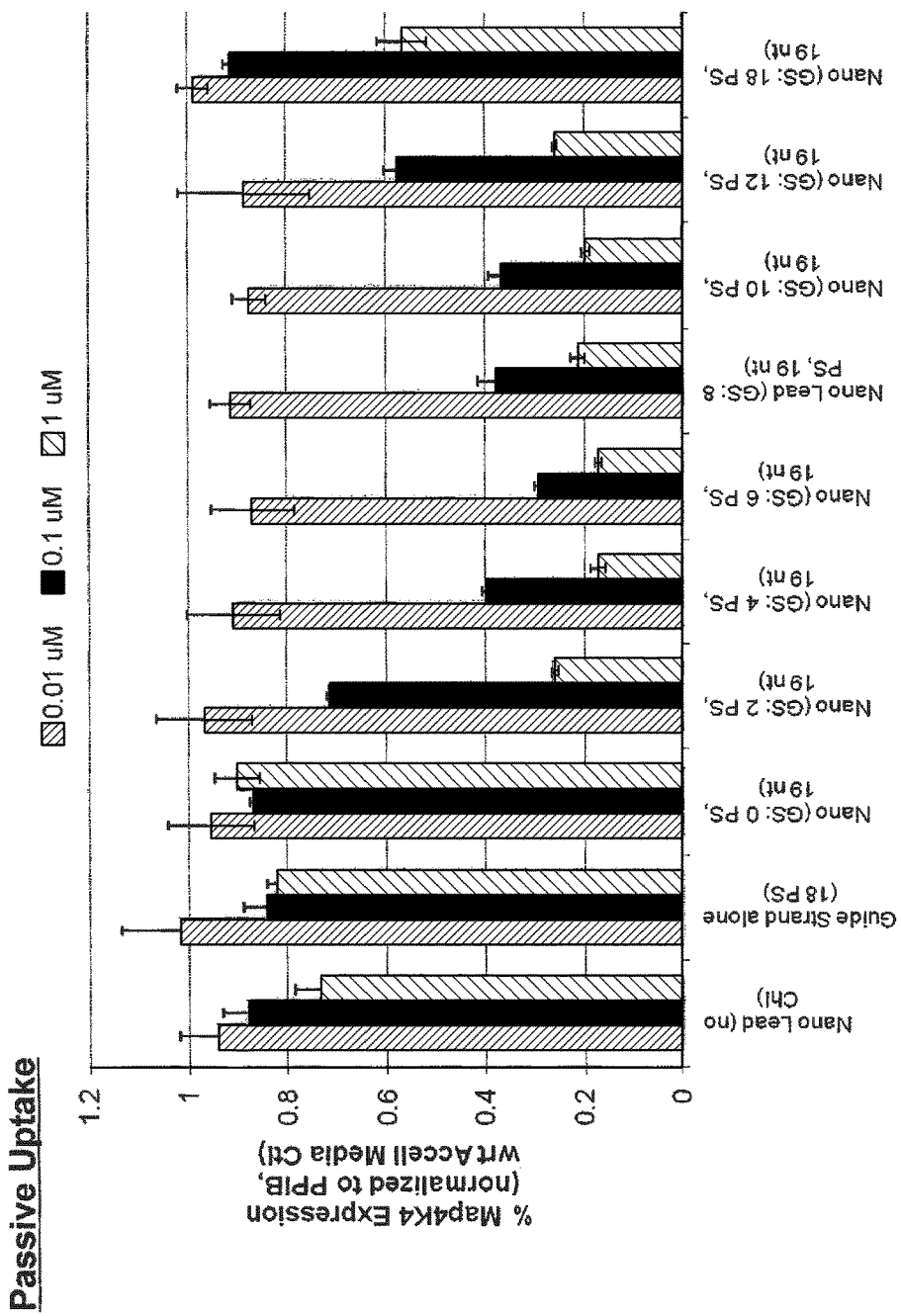
FIG. 42 is a graph showing percent MAP4K4 expression in HeLa cells following passive uptake transfection of: Nano Lead (no Chl); Guide Strand alone (18 PS); Nano (GS: 0 PS, 19 nt); Nano (GS: 2 PS, 19 nt); Nano (GS: 4 PS, 19 nt); Nano (GS: 6 PS, 19 nt); Nano Lead (GS: 8 PS, 19 nt); Nano (GS: 10 PS, 19 nt); Nano (GS: 12 PS, 19 nt); and Nano (GS: 18 PS, 19 nt).

A summary of 1$^{st}$ generation sd-rxRNA molecules is presented in FIG. 21. Chemical modifications were introduced into the RNA molecules, at least in part, to increase potency, such as through optimization of nucleotide length and phosphorothioate content, to reduce toxicity, such as through replacing 2'F modifications on the guide strand with other modifications, to improve delivery such as by adding or conjugating the RNA molecules to linker and sterol modalities, and to improve the ease of manufacturing the RNA molecules. FIG. 35 presents schematic depictions of some of the chemical modifications that were screened in 1$^{st}$ generation molecules. Parameters that were optimized for the guide strand included nucleotide length (e.g., 19, 21 and 25 nucleotides), phosphorothioate content (e.g., 0-18 phosphorothioate linkages) and replacement of 2'F groups with 2'OMe and 5 Me C or riboThymidine. Parameters that were optimized for the sense strand included nucleotide length (e.g., 11, 13 and 19 nucleotides), phosphorothioate content (e.g., 0-4 phosphorothioate linkages), and 2'OMe modifications. FIG. 36 summarizes parameters that were screened. For example, the nucleotide length and the phosphorothioate tail length were modified and screened for optimization, as were the additions of 2'OMe C and U modifications. Guide strand length and the length of the phosphorothioate modified stretch of nucleotides were found to influence efficacy (FIGS. 37-38). Phosphorothioate modifications were tolerated in the guide strand and were found to influence passive uptake (FIGS. 39-42).

Figure 44:
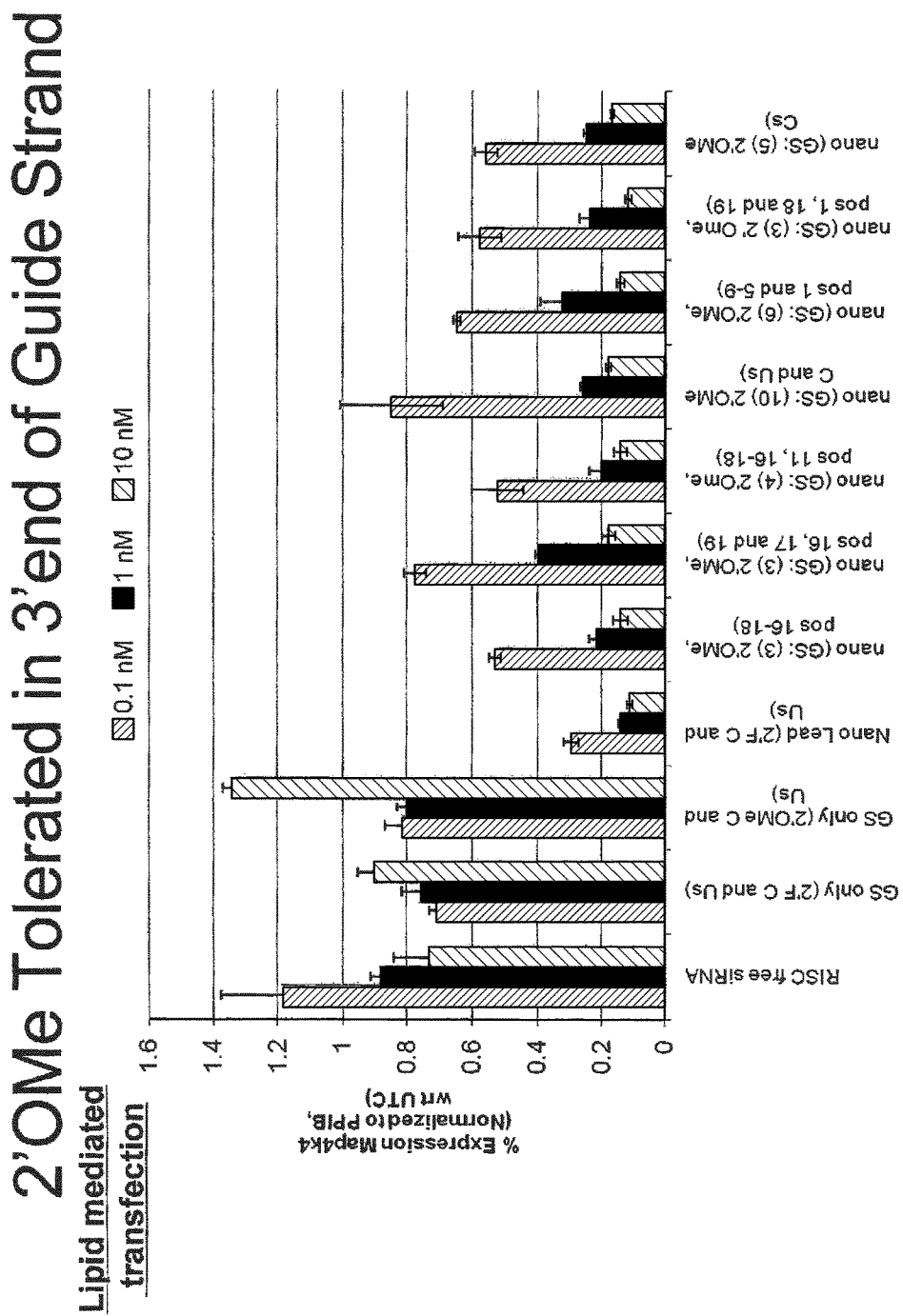
FIG. 44 is a graph showing percent MAP4K4 expression in Hek293 cells following reverse transfection of: RISC free siRNA; GS only (2'F C and Us); GS only (2'OMe C and Us); Nano Lead (2'F C and Us); nano (GS: (3) 2'OMe, positions 16-18); nano (GS: (3) 2'OMe, positions 16, 17 and 19); nano (GS: (4) 2'OMe, positions 11, 16-18); nano (GS: (10) 2'OMe, C and Us); nano (GS: (6) 2'OMe, positions 1 and 5-9); nano (GS: (3) 2'OMe, positions 1, 18 and 19); and nano (GS: (5) 2'OMe Cs).
Figure 45:
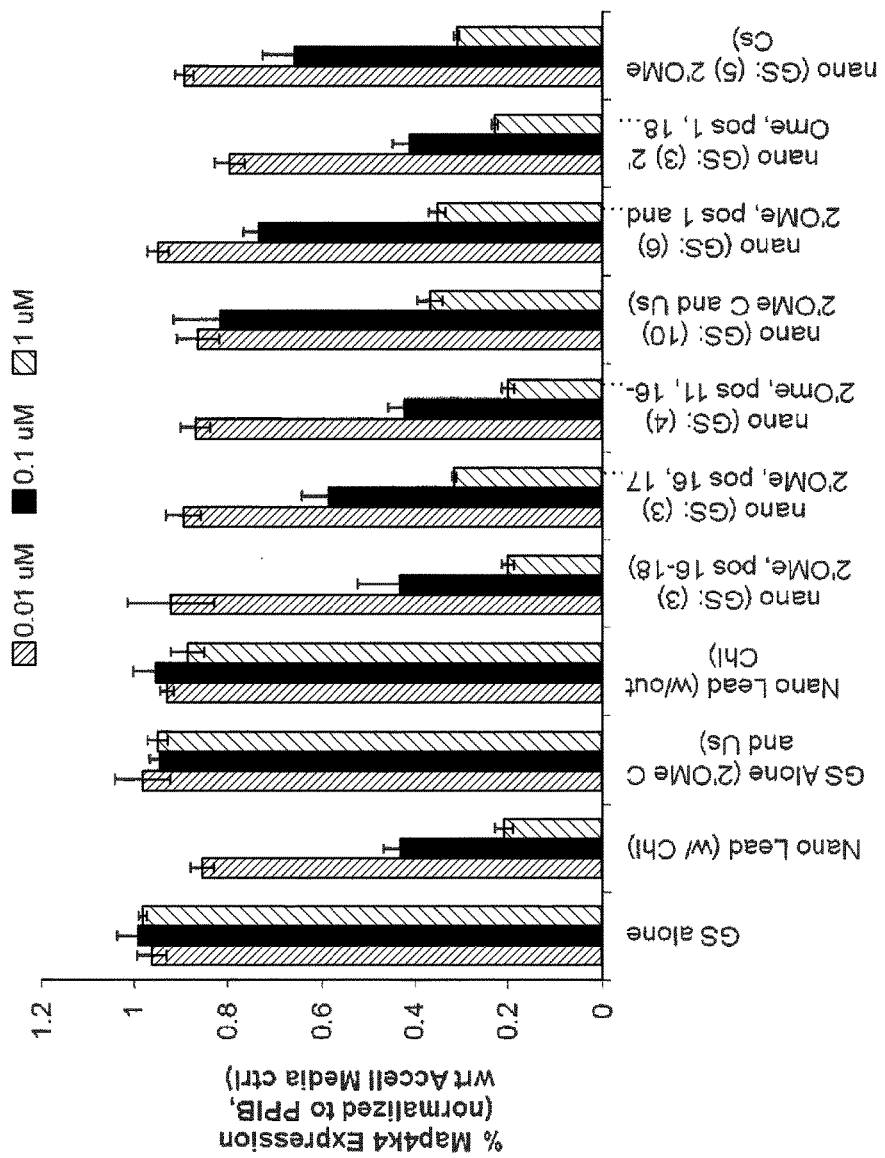
FIG. 45 is a graph demonstrating efficacy of various chemical modification patterns. In particular, 2-OMe modification in positions 1 and 11-18 was well tolerated. 2'OMe modifications in the seed area resulted in a slight reduction of efficacy (but were still highly efficient). Ribo-modifications in the seed were well tolerated. This data enabled the generation of self delivering compounds with reduced or no 2'F modifications. This is significant because 2'F modifications may be associated with toxicity in vivo.

FIG. 43 presents a schematic revealing guide strand chemical modifications that were screened. FIGS. 44 and 45 reveal that 2'OMe modifications were tolerated in the 3' end of the guide strand. In particular, 2'OMe modifications in positions 1 and 11-18 were well tolerated. The 2'OMe modifications in the seed area were tolerated but resulted in slight reduction of efficacy. Ribo-modifications in the seed were also well tolerated. These data indicate that the molecules associated with the invention offer the significant advantage of having reduced or no 2'F modification content. This is advantageous because 2'F modifications are thought to generate toxicity in vivo. In some instances, a complete substitution of 2'F modifications with 2'OMe was found to lead to some reduction in potency. However, the 2' OMe substituted molecules were still very active. A molecule with 50% reduction in 2'F content (including at positions 11, 16-18 which were changed to 2'OMe modifications), was found to have comparable efficacy to a compound with complete 2'F C and U modification. 2'OMe modification in position was found in some instances to reduce efficacy, although this can be at least partially compensated by 2'OMe modification in position 1 (with chemical phosphate). In some instances, 5 Me C and/or ribothymidine substitution for 2'F modifications led to a reduction in passive uptake efficacy, but increased potency in lipid mediated transfections compared to 2'F modifications. Optimization results for lipid mediated transfection were not necessarily the same as for passive uptake.

Figure 46:
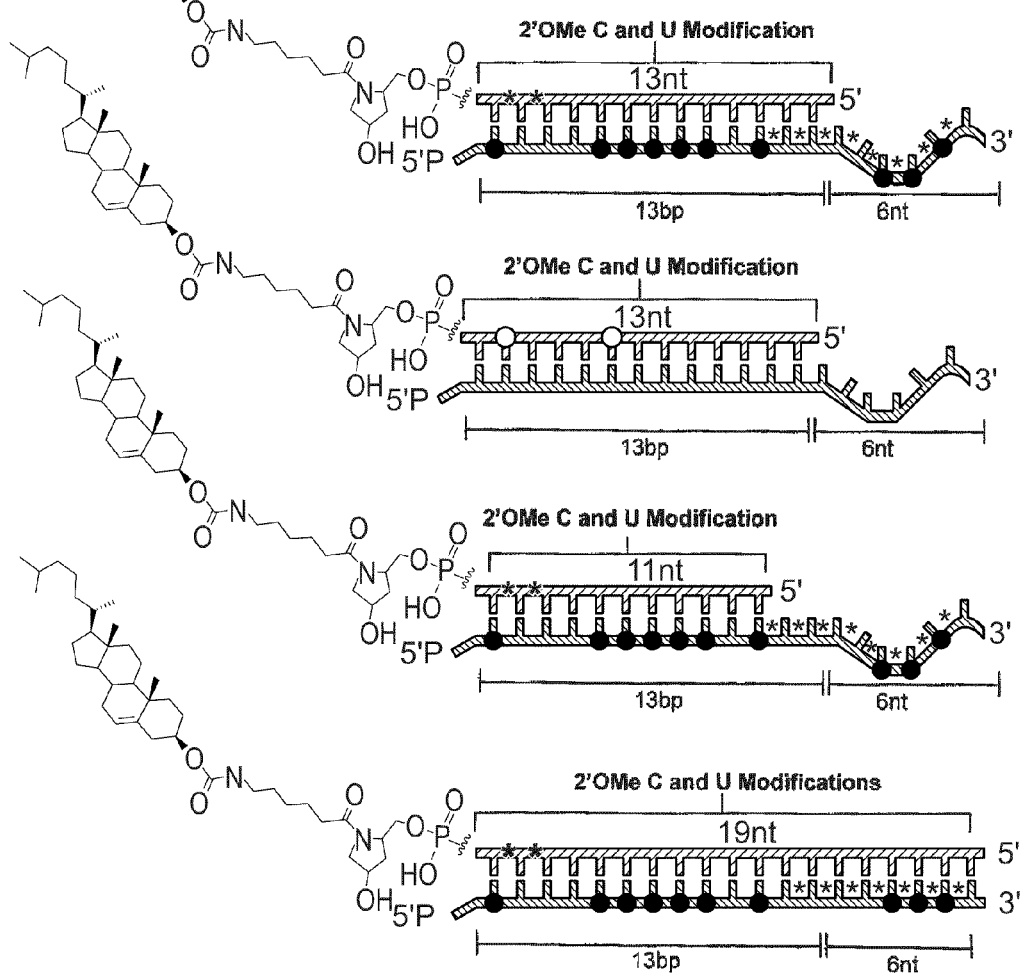
FIG. 46 is a schematic depicting sense strand modifications.
Figure 47:
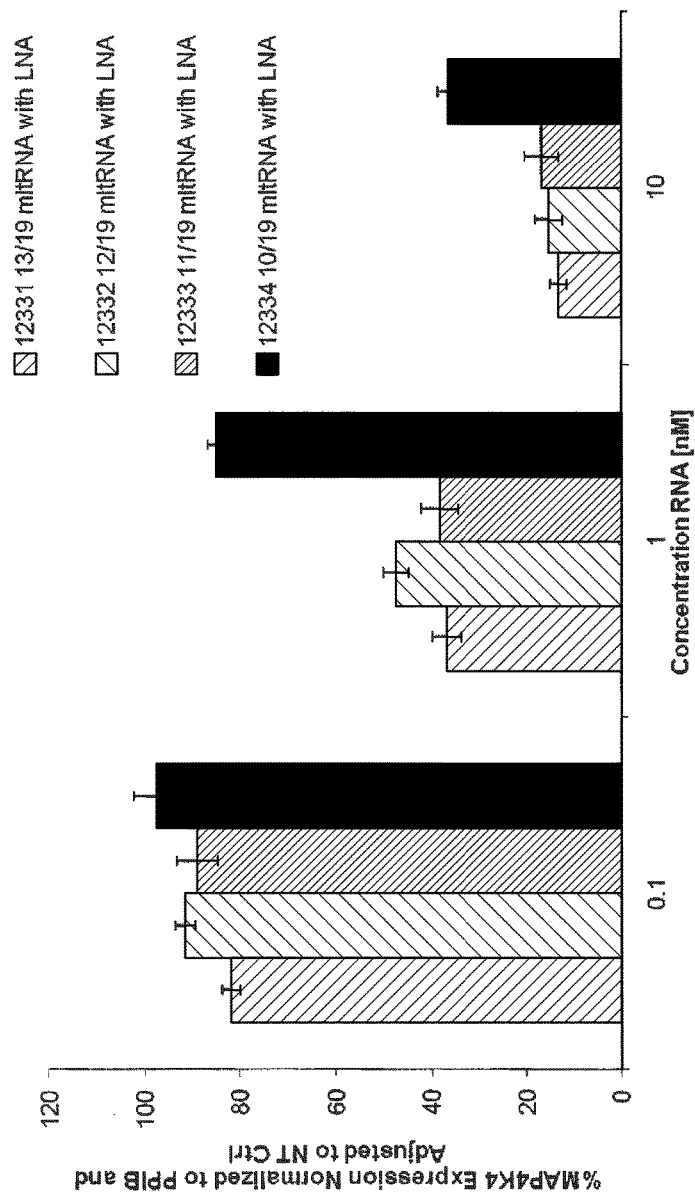
FIG. 47 is a graph demonstrating sense strand length optimization. A sense strand length between 10-15 bases was found to be optimal in this assay. Increasing sense strand length resulted in a reduction of passive uptake of these compounds but may be tolerated for other compounds. Sense strands containing LNA modification demonstrated similar efficacy to non-LNA containing compounds. In some embodiments, the addition of LNA or other thermodynamically stabilizing compounds can be beneficial, resulting in converting non-functional sequences into functional sequences.
Figure 48:
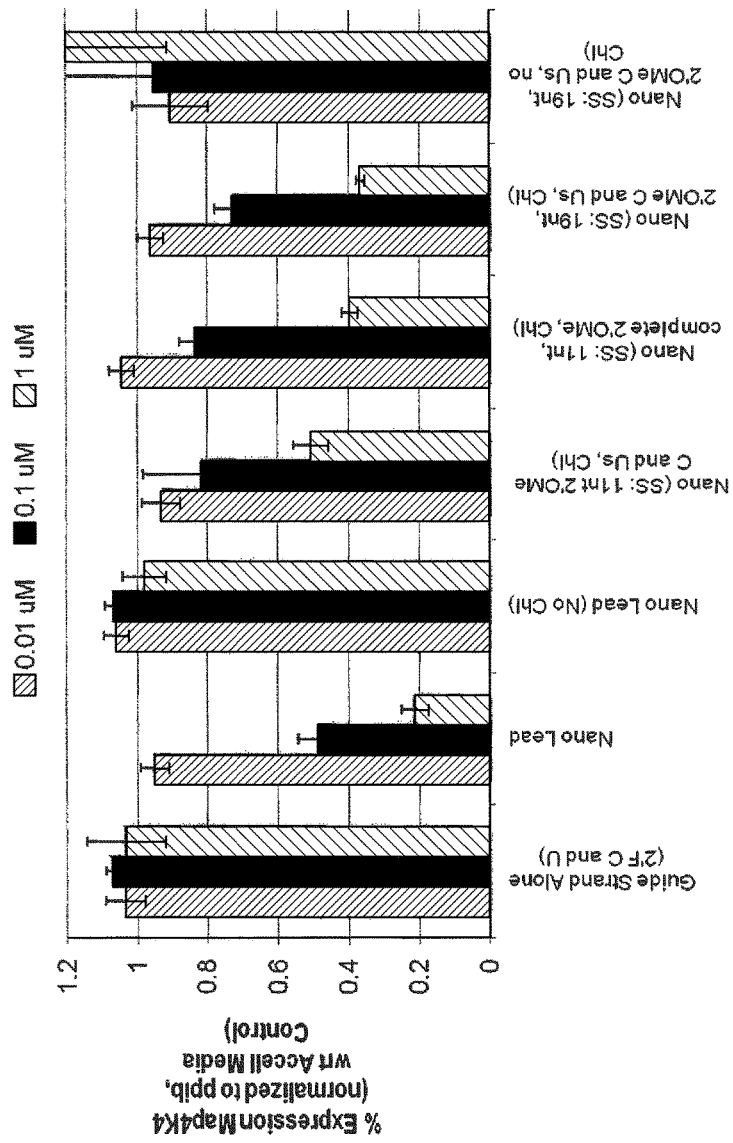
FIG. 48 is a graph showing percent MAP4K4 expression in HeLa cells following passive uptake transfection of: Guide Strand Alone (2'F C and U); Nano Lead; Nano Lead (No Chl); Nano (SS: 11 nt 2'OMe C and Us, Chl); Nano (SS: 11nt, complete 2'OMe, Chl); Nano (SS: 19 nt, 2'OMe C and Us, Chl); Nano (SS: 19 nt, 2'OMe C and Us, no Chl).
Figure 49:
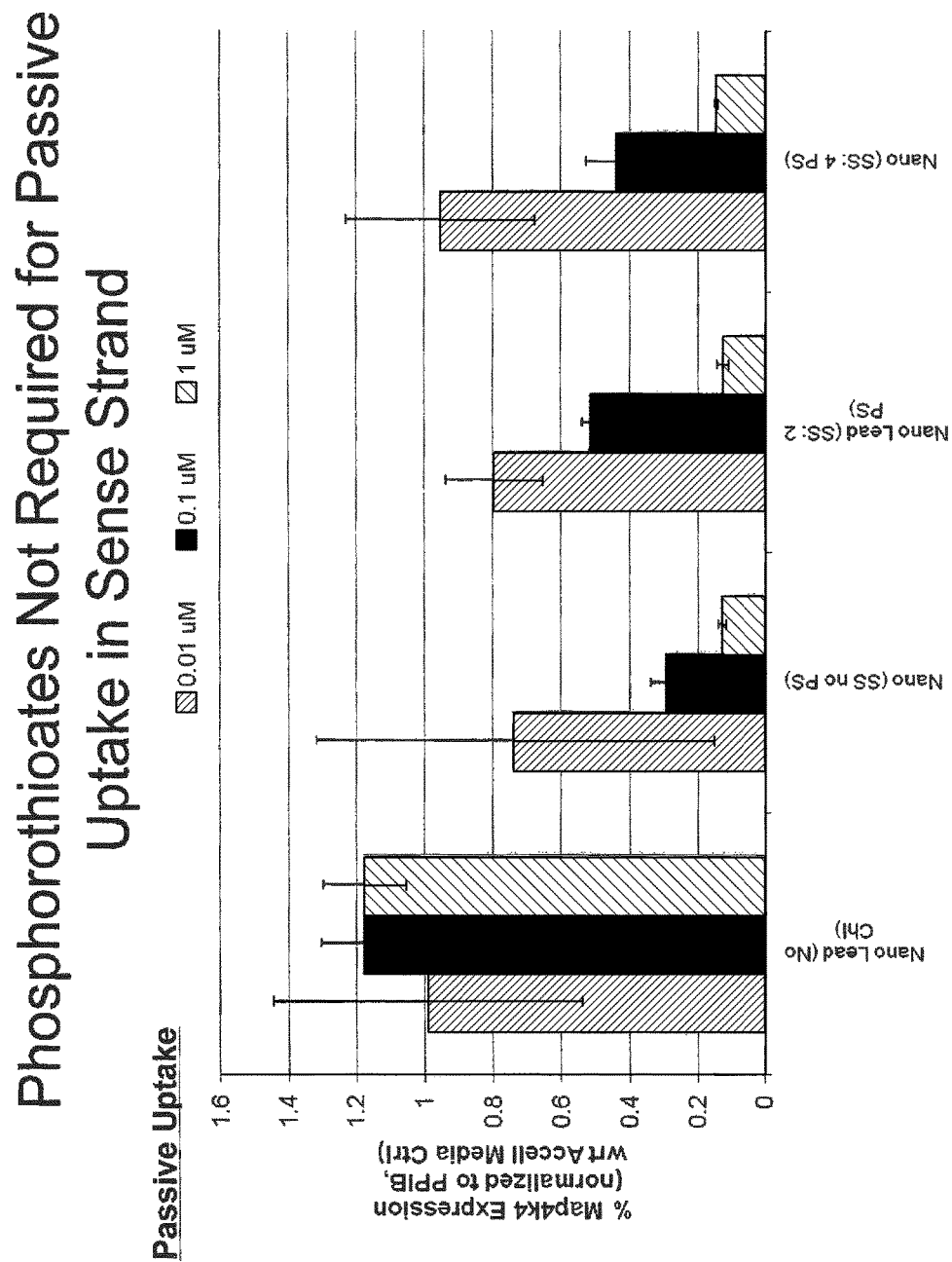
FIG. 49 is a graph showing percent MAP4K4 expression in HeLa cells following passive uptake transfect of: Nano Lead (No Chl); Nano (SS no PS); Nano Lead (SS:2 PS); Nano (SS:4 PS).

Modifications to the sense strand were also developed and tested, as depicted in FIG. 46. FIG. 47 reveals that in some instances, a sense strand length between 10-15 bases was found to be optimal. For the molecules tested in FIG. 47, an increase in the sense strand length resulted in reduction of passive uptake, however an increase in sense strand length may be tolerated for some compounds. FIG. 47 also reveals that LNA modification of the sense strand demonstrated similar efficacy to non-LNA containing compounds. In general, the addition of LNA or other thermodynamically stabilizing compounds has been found to be beneficial, in some instances resulting in converting non-functional sequences to functional sequences. FIG. 48 also presents data on sense strand length optimization, while FIG. 49 shows that phosphorothioate modification of the sense strand is not required for passive uptake.

Figure 50:
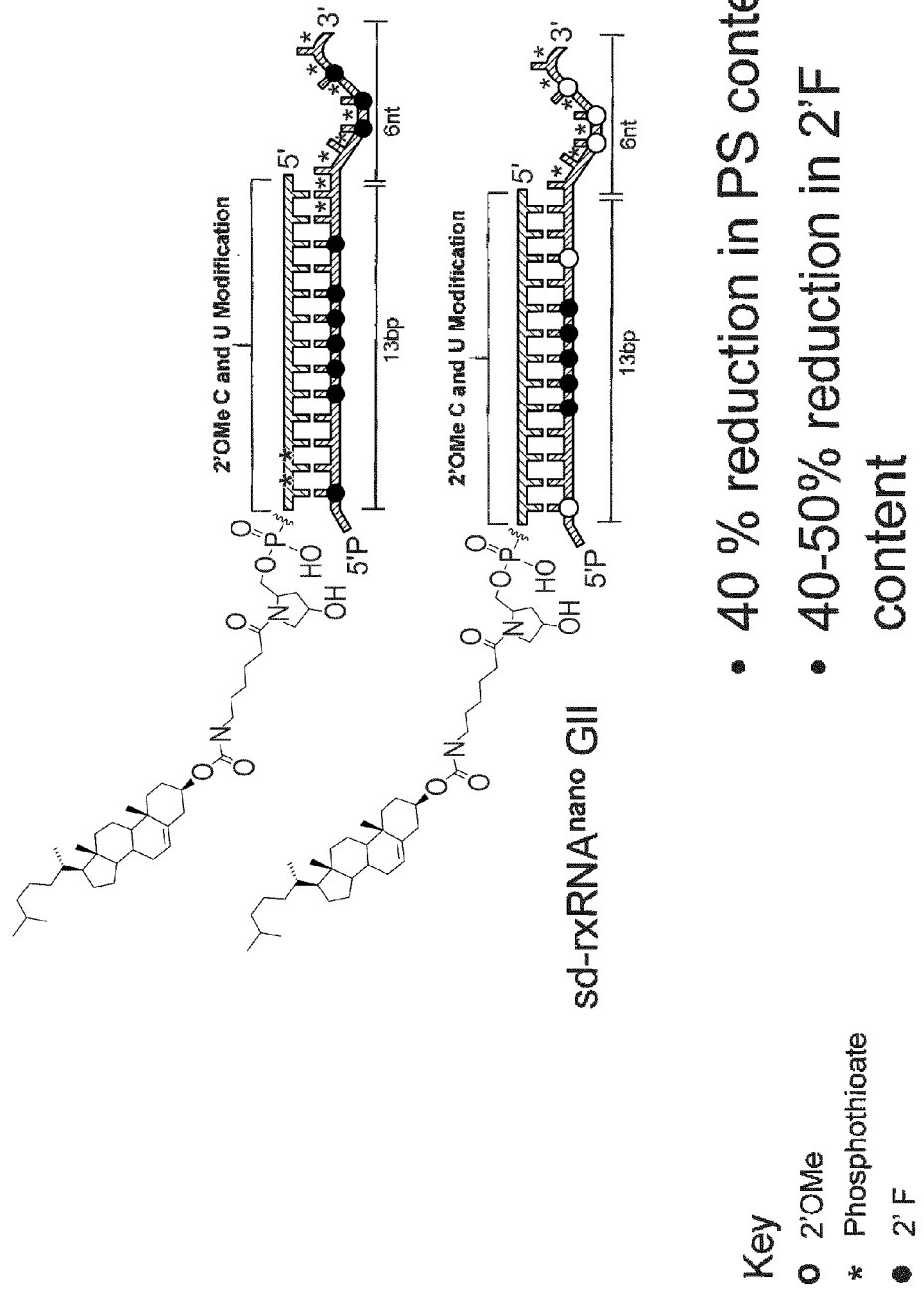
FIG. 50 is a schematic depicting a sd-rxRNA$^{nano}$ second generation (GM lead molecule.
Figure 52:
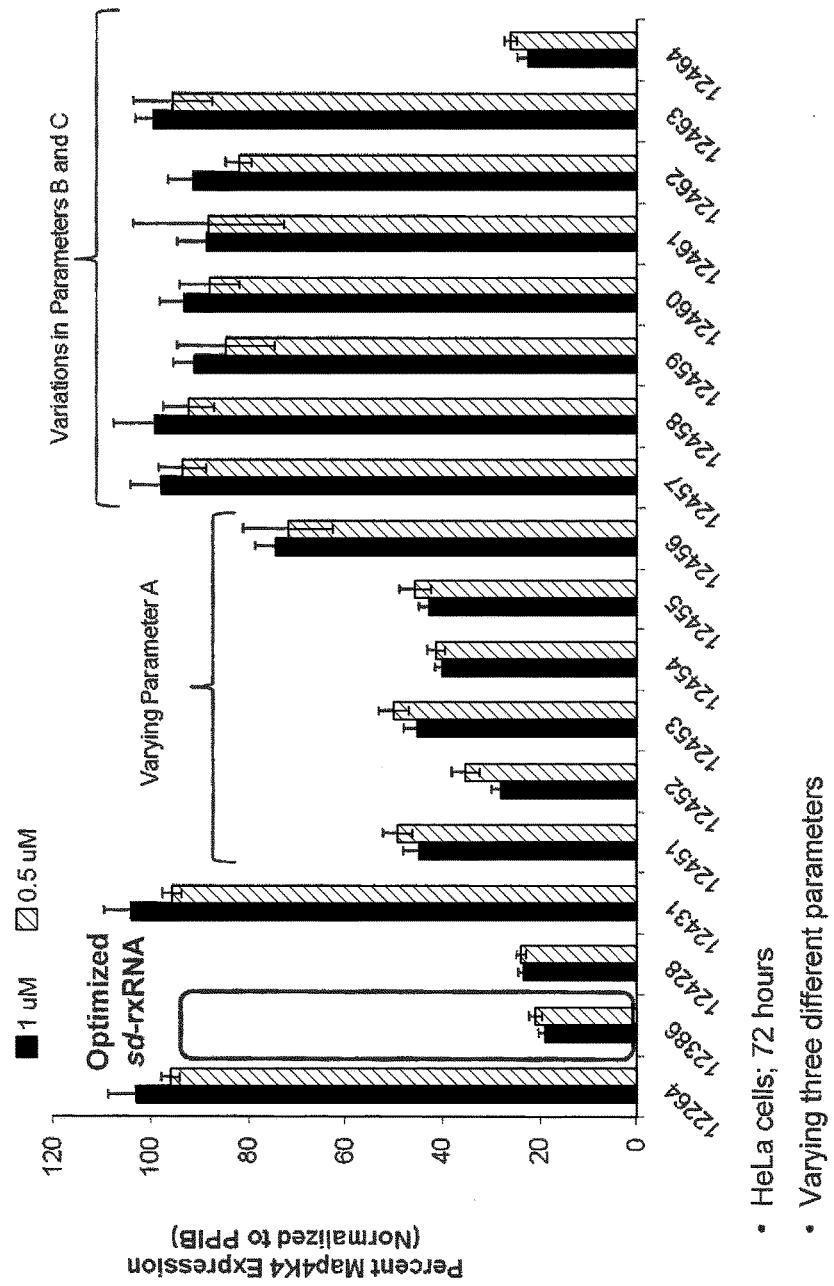
FIG. 52 is a graph showing percent MAP4K4 expression in HeLa cells in the presence of optimized sd-rxRNA molecules.
Figure 53:
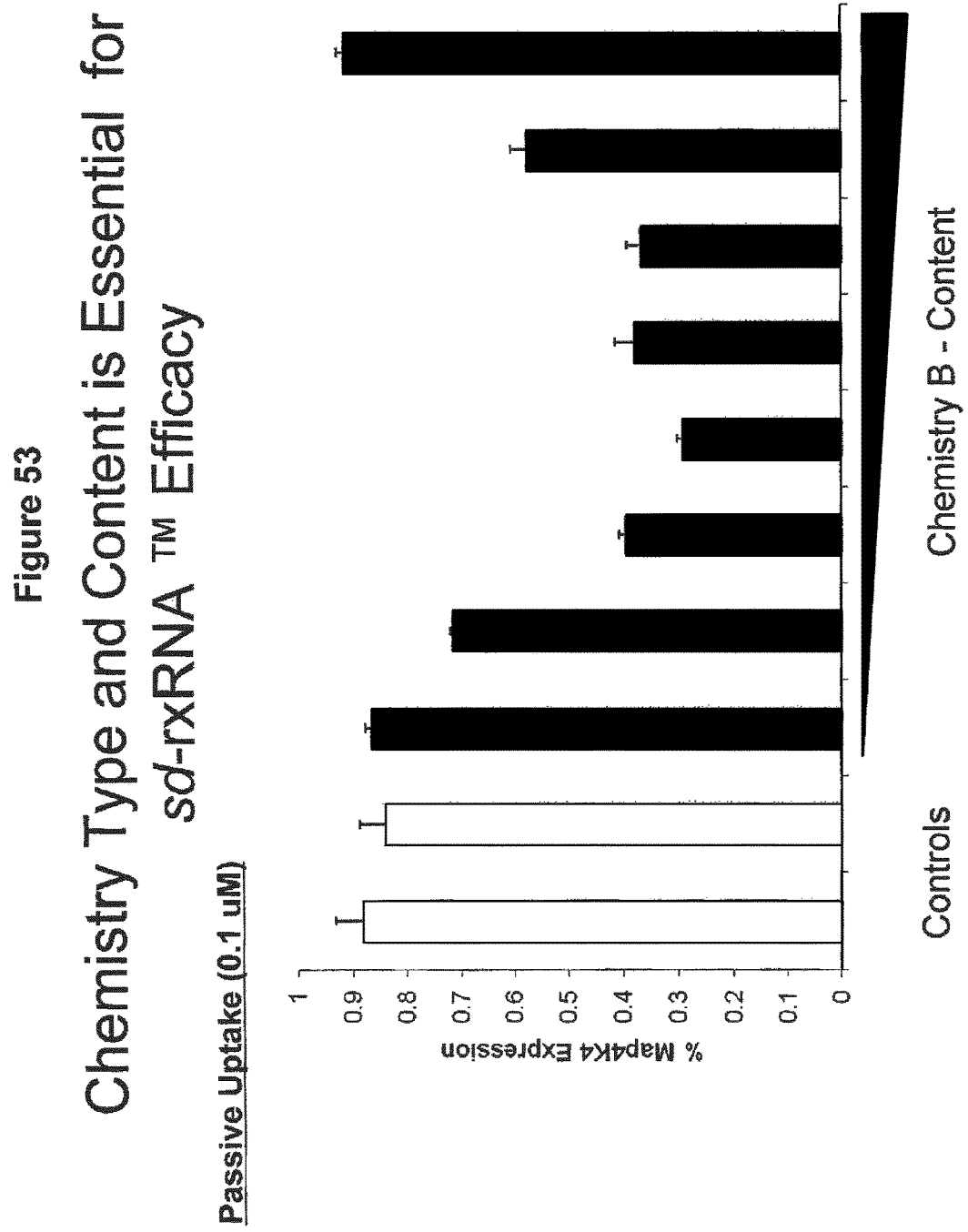
FIG. 53 is a graph depicting the relevance of chemistry content in optimization of sd-rxRNA efficacy.

Based on the above-described optimization experiments, 2$^{nd}$ generation RNA molecules were developed. As shown in FIG. 50, these molecules contained reduced phosphorothioate modification content and reduced 2'F modification content, relative to 1st generation RNA molecules. Significantly, these RNA molecules exhibit spontaneous cellular uptake and efficacy without a delivery vehicle (FIG. 51). These molecules can achieve self-delivery (i.e., with no transfection reagent) and following self-delivery can exhibit nanomolar activity in cell culture. These molecules can also be delivered using lipid-mediated transfection, and exhibit picomolar activity levels following transfection. Significantly, these molecules exhibit highly efficient uptake, 95% by most cells in cell culture, and are stable for more than three days in the presence of 100% human serum. These molecules are also highly specific and exhibit little or no immune induction. FIGS. 52 and 53 reveal the significance of chemical modifications and the configurations of such modifications in influencing the properties of the RNA molecules associated with the invention.

Figure 54:
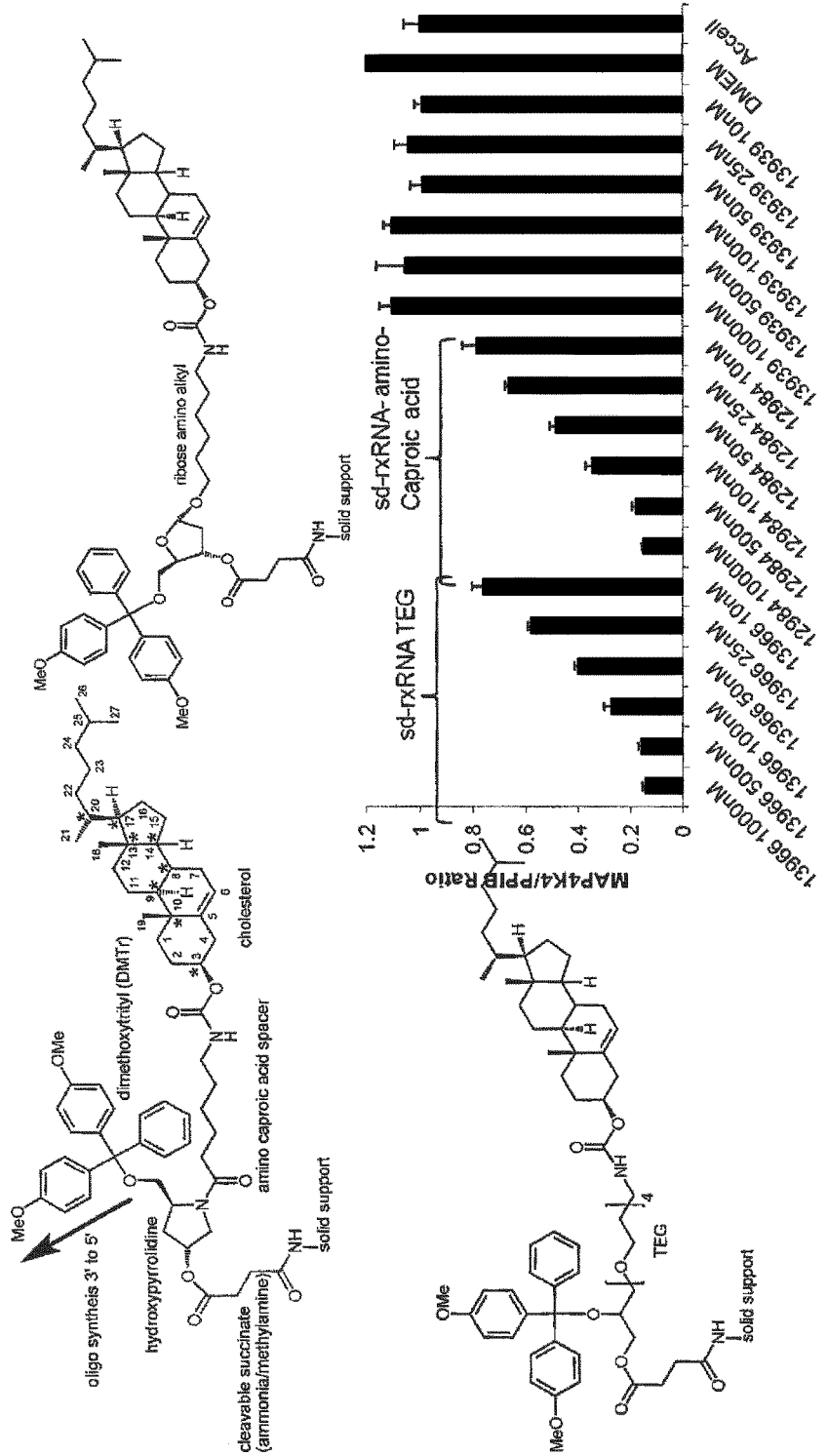
FIG. 54 presents schematics of sterol-type molecules and a graph revealing that sd-rxRNA compounds are fully functional with a variety of linker chemistries. GII asymmetric compounds were synthesized with sterol type molecules attached through TEG and amino caproic acid linkers. Both linkers showed identical potency. This functionality independent of linker chemistry indicates a significant difference between the molecules described herein and previously described molecules, and offers significant advantages for the molecules described herein in terms of scale up and synthesis.

Linker chemistry was also tested in conjunction with the RNA molecules associated with the invention. As depicted in FIG. 54, 2nd generation RNA molecules were synthesized with sterol-type molecules attached through TEG and amino caproic acid linkers. Both linkers showed identical potency. This functionality of the RNA molecules, independent of linker chemistry offers additional advantages in terms of scale up and synthesis and demonstrates that the mechanism of function of these RNA molecules is very different from other previously described RNA molecules.

Figure 55:
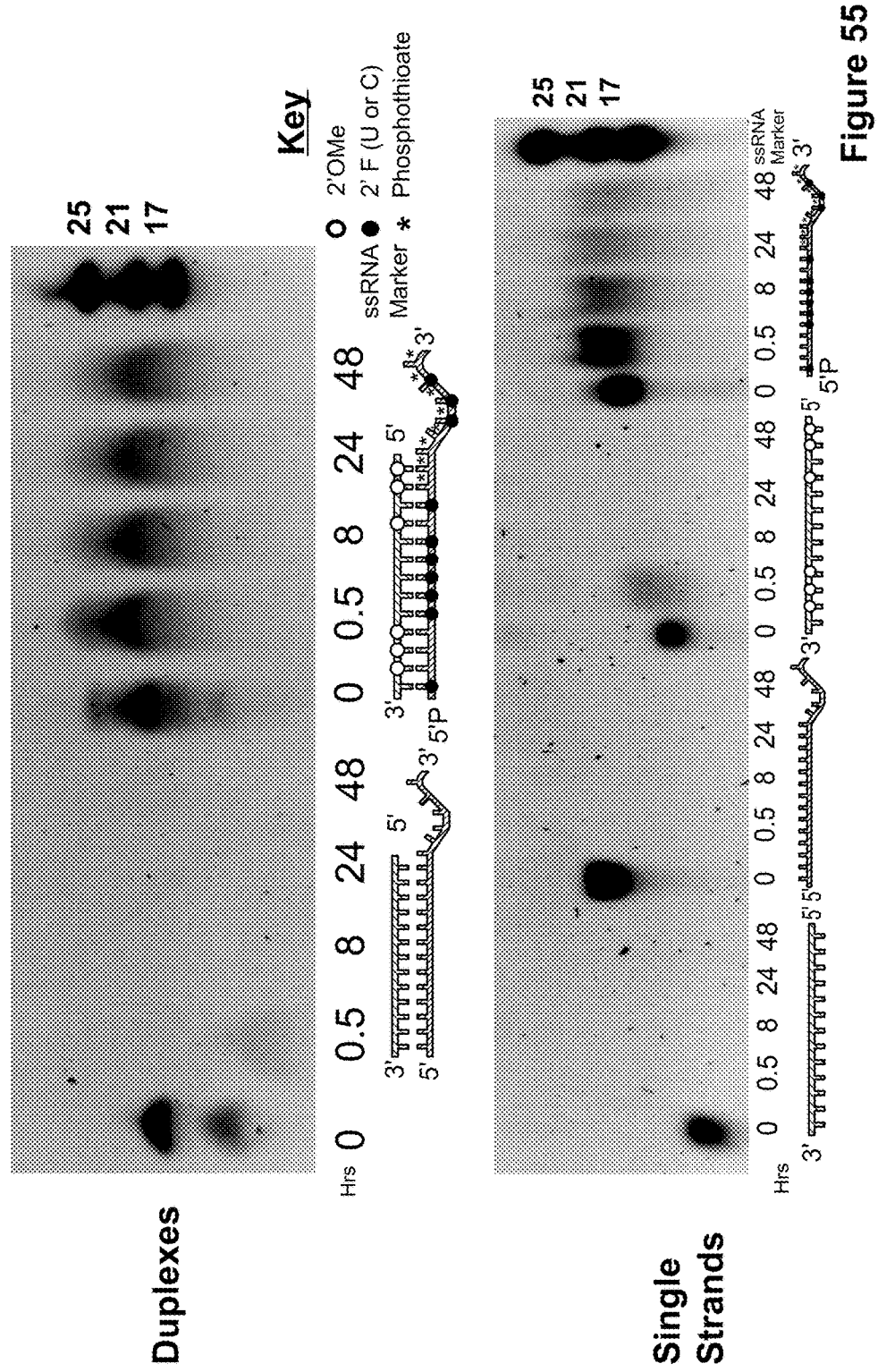
FIG. 55 demonstrates the stability of chemically modified sd-rxRNA compounds in human serum in comparison to non modified RNA. The oligonucleotides were incubated in 75% serum at 37° C. for the number of hours indicated. The level of degradation was determined by running the samples on non-denaturing gels and staining with SYBGR.

Stability of the chemically modified sd-rxRNA molecules described herein in human serum is shown in FIG. 55 in comparison to unmodified RNA. The duplex molecules were incubated in 75% serum at 37° C. for the indicated periods of time. The level of degradation was determined by running the samples on non-denaturing gels and staining with SYBGR.

Figure 56:
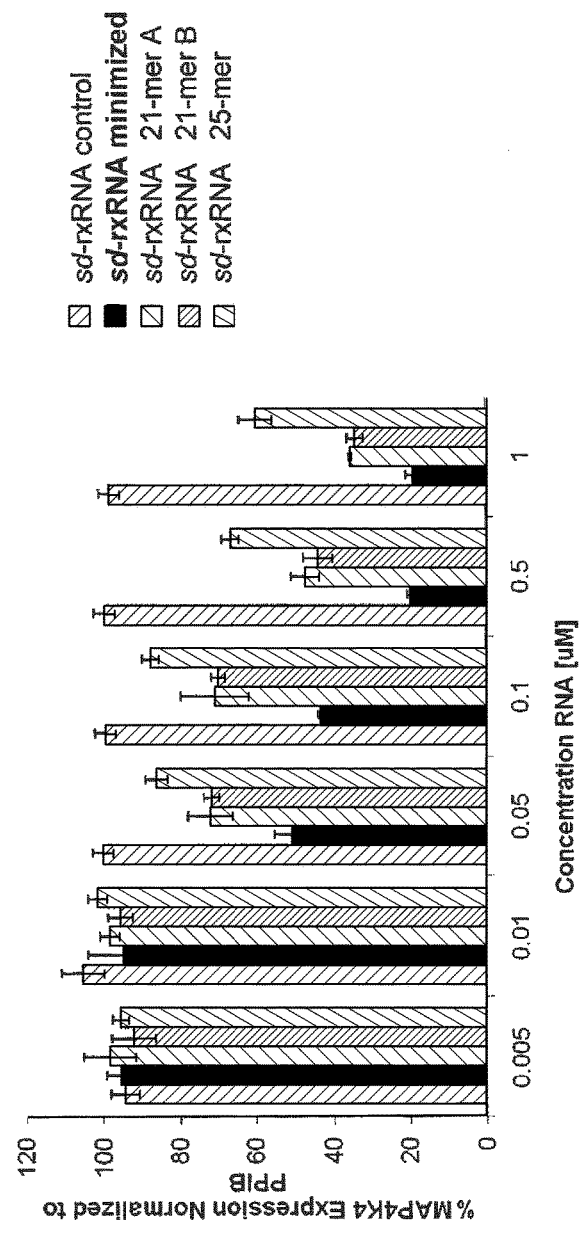
FIG. 56 is a graph depicting optimization of cellular uptake of sd-rxRNA through minimizing oligonucleotide content.
Figure 57:
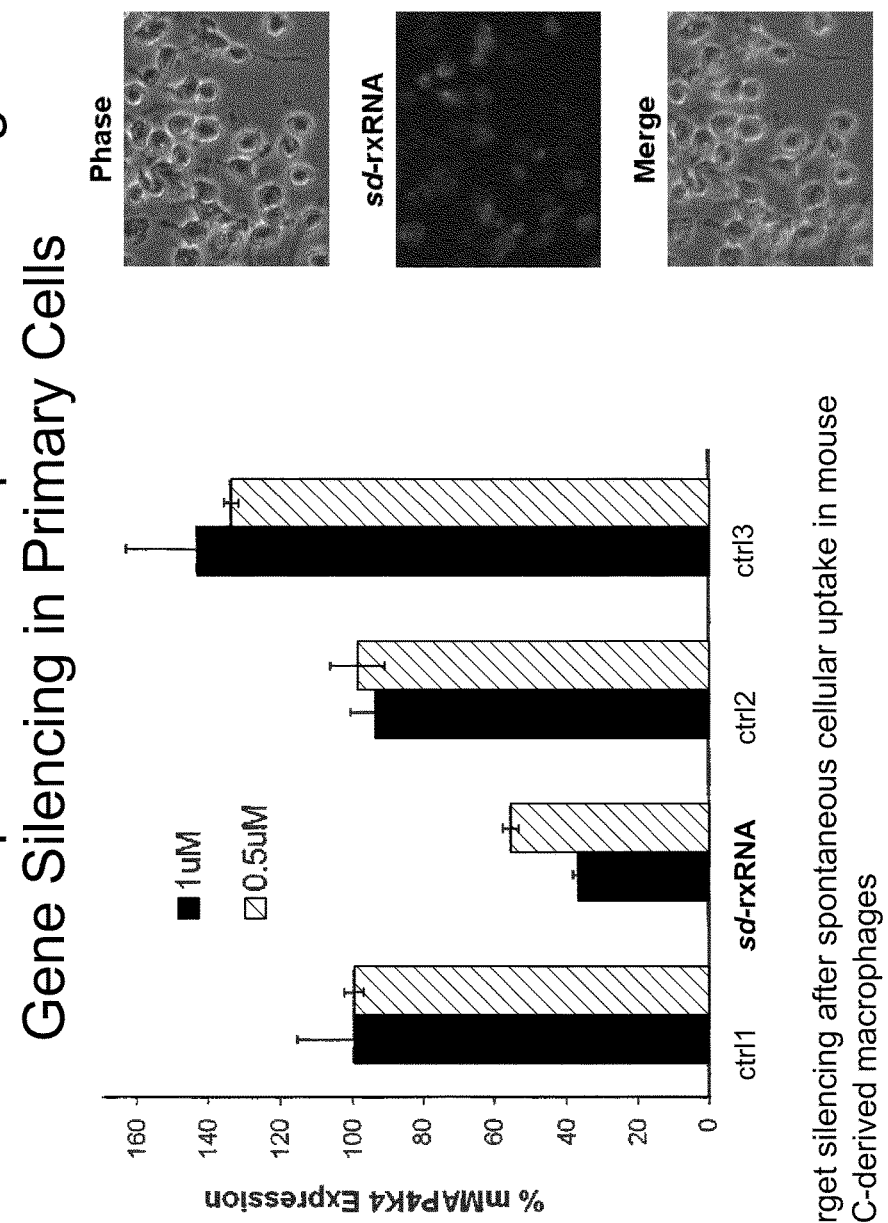
FIG. 57 is a graph showing percent MAP4K4 expression after spontaneous cellular uptake of sd-rxRNA in mouse PEC-derived macrophages, and phase and fluorescent images showing localization of sd-rxRNA.
Figure 58:
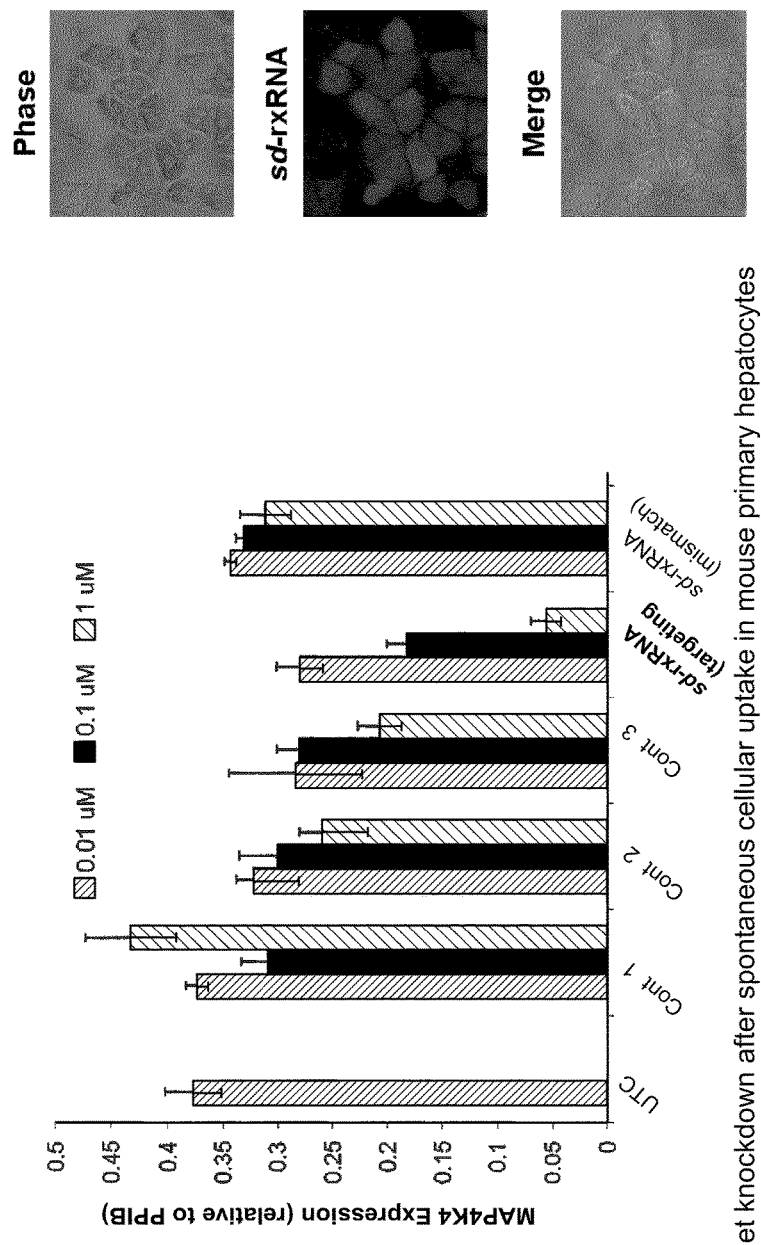
FIG. 58 is a graph showing percent MAP4K4 expression after spontaneous cellular uptake of sd-rxRNA (targeting) and sd-rxRNA (mismatch) in mouse primary hepatocytes, and phase and fluorescent images showing localization of sd-rxRNA.
Figure 59:
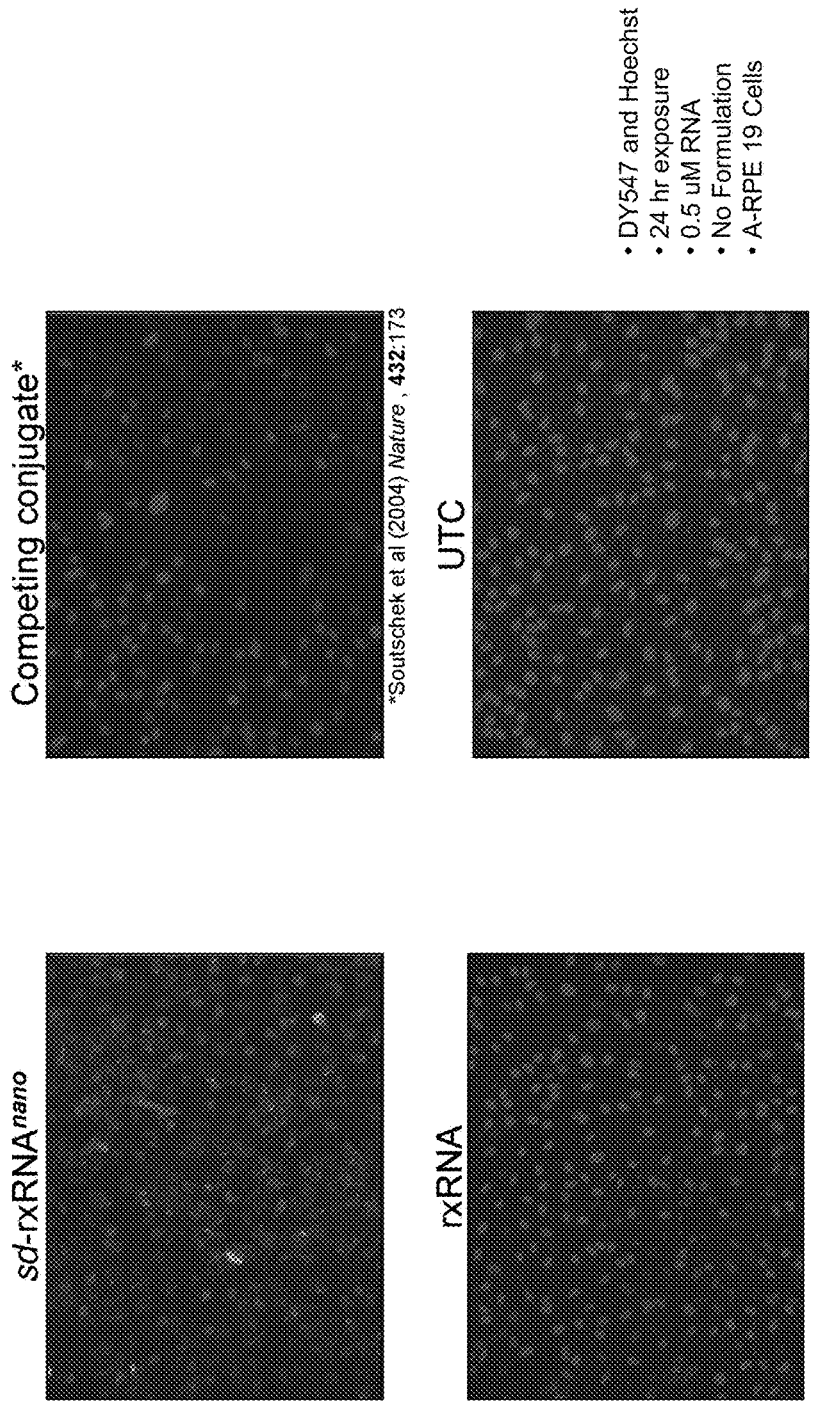
FIG. 59 presents images depicting localization of DY547-labeled sd-rxRNA delivered to RPE cells with no formulation.
Figure 60:
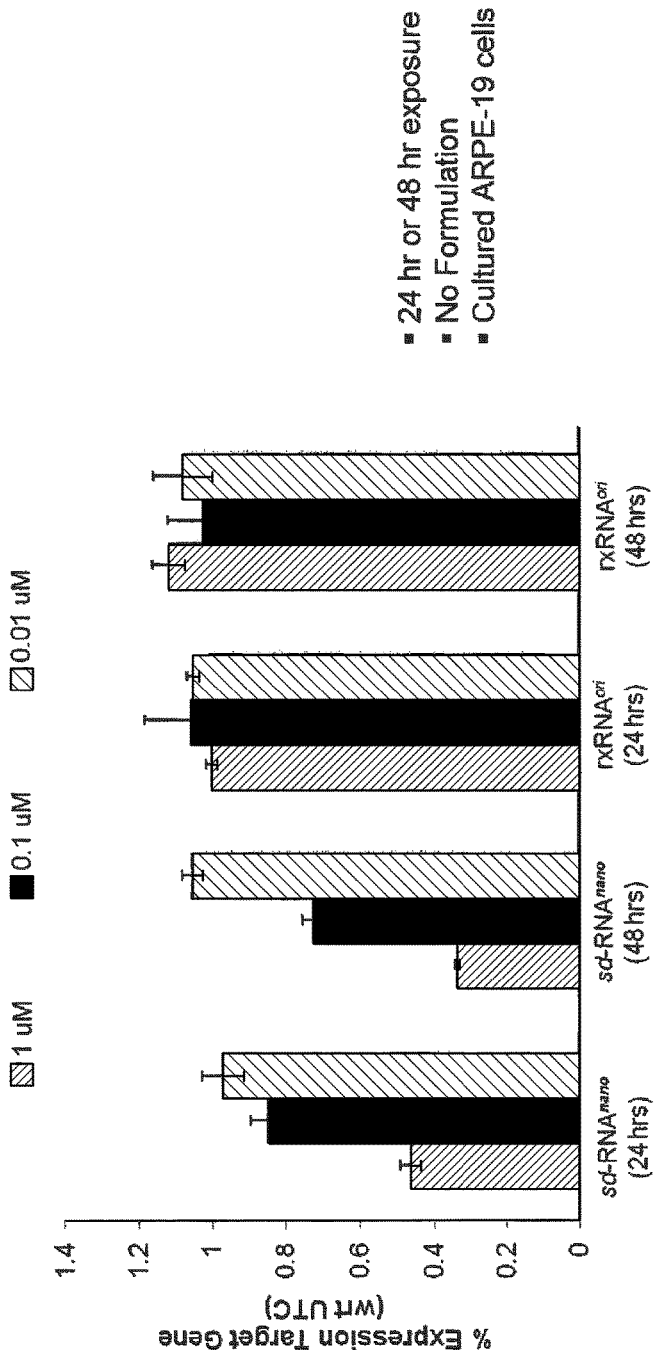
FIG. 60 is a graph showing silencing of MAP4K4 expression in RPE cells treated with sd-rxRNA$^{nano}$ without formulation.

FIGS. 56 and 57 present data on cellular uptake of the sd-rxRNA molecules. FIG. 56 shows that minimizing the length of the RNA molecule is importance for cellular uptake, while FIG. 57 presents data showing target gene silencing after spontaneous cellular uptake in mouse PEC-derived macrophages. FIG. 58 demonstrates spontaneous uptake and target gene silencing in primary cells. FIG. 59 shows the results of delivery of sd-rxRNA molecules associated with the invention to RPE cells with no formulation. Imaging with Hoechst and DY547 reveals the clear presence of a signal representing the RNA molecule in the sd-rxRNA sample, while no signal is detectable in the other samples including the samples competing a competing conjugate, an rxRNA, and an untransfected control. FIG. 60 reveals silencing of target gene expression in RPE cells treated with sd-rxRNA molecules associated with the invention following 24-48 hours without any transfection formulation.

Figure 61:
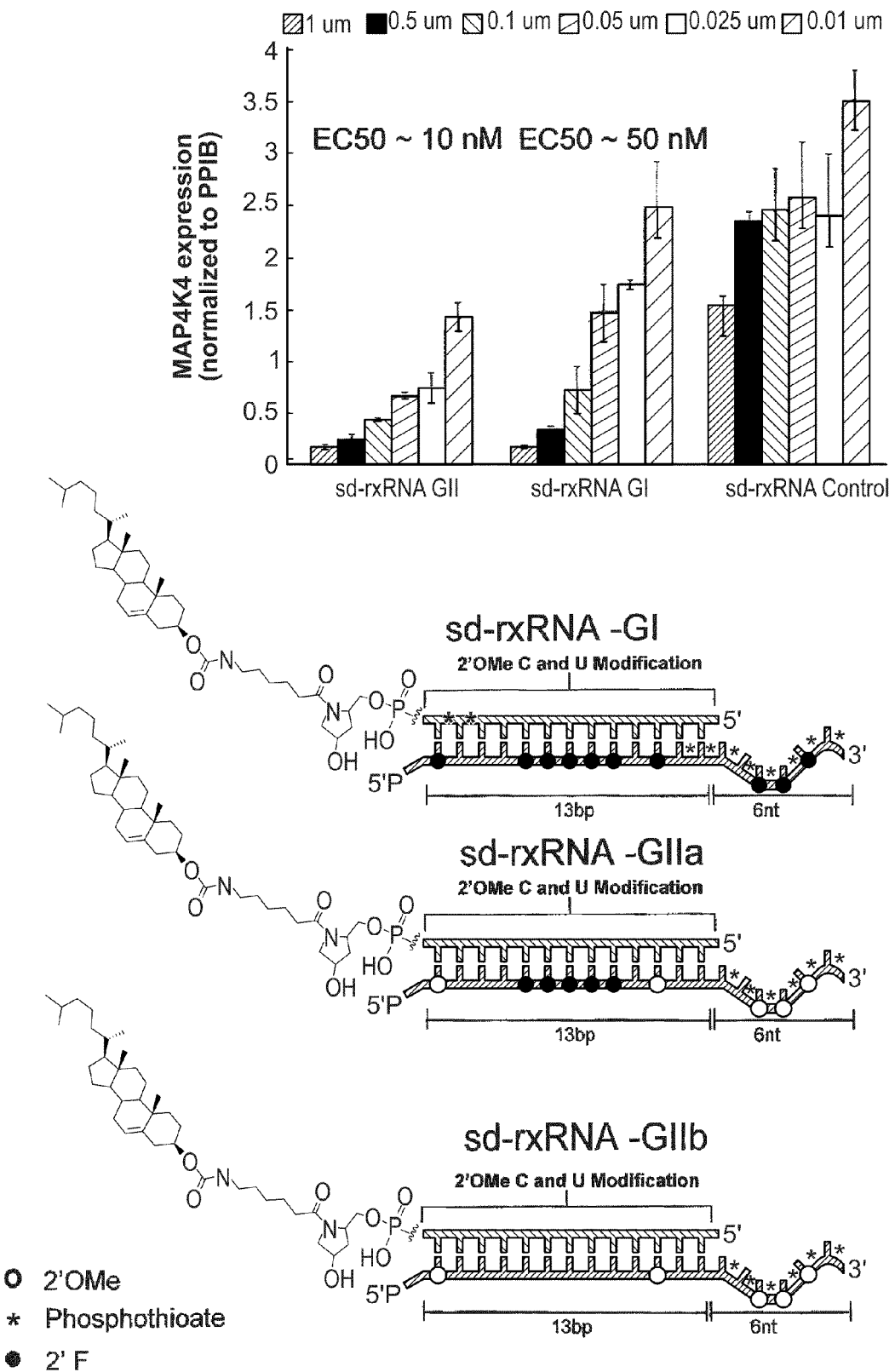
FIG. 61 presents a graph and schematics of RNAi compounds showing the chemical/structural composition of highly effective sd-rxRNA compounds. Highly effective compounds were found to have the following characteristics: antisense strands of 17-21 nucleotides, sense strands of 10-15 nucleotides, single-stranded regions that contained 2-12 phosphorothioate modifications, preferentially 6-8 phosphorothioate modifications, and sense strands in which the majority of nucleotides were 2'OMe modified, with or without phosphorothioate modification. Any linker chemistry can be used to attach these molecules to hydrophobic moieties such as cholesterol at the 3' end of the sense strand. Version GIIa-b of these RNA compounds demonstrate that elimination of 2'F content has no impact on efficacy.

FIG. 61 shows further optimization of the chemical/structural composition of sd-rxRNA compounds. In some instances, preferred properties included an antisense strand that was 17-21 nucleotides long, a sense strand that was 10-15 nucleotides long, phosphorothioate modification of 2-12 nucleotides within the single stranded region of the molecule, preferentially phosphorothioate modification of 6-8 nucleotides within the single stranded region, and 2'OMe modification at the majority of positions within the sense strand, with or without phosphorothioate modification. Any linker chemistry can be used to attach the hydrophobic moiety, such as cholesterol, to the 3' end of the sense strand. Version GIIb molecules, as shown in FIG. 61, have no 2'F modifications. Significantly, there is was no impact on efficacy in these molecules.

FIG. 62 demonstrates the superior performance of sd-rxRNA compounds compared to compounds published by Wolfrum et. al. Nature Biotech, 2007. Both generation I and II compounds (GI and GIIa) developed herein show great efficacy in reducing target gene expression. By contrast, when the chemistry described in Wolfrum et al. (all oligos contain cholesterol conjugated to the 3' end of the sense strand) was applied to the same sequence in a context of conventional siRNA (19 bp duplex with two overhang) the compound was practically inactive. These data emphasize the significance of the combination of chemical modifications and asymmetrical molecules described herein, producing highly effective RNA compounds.

Figure 63:
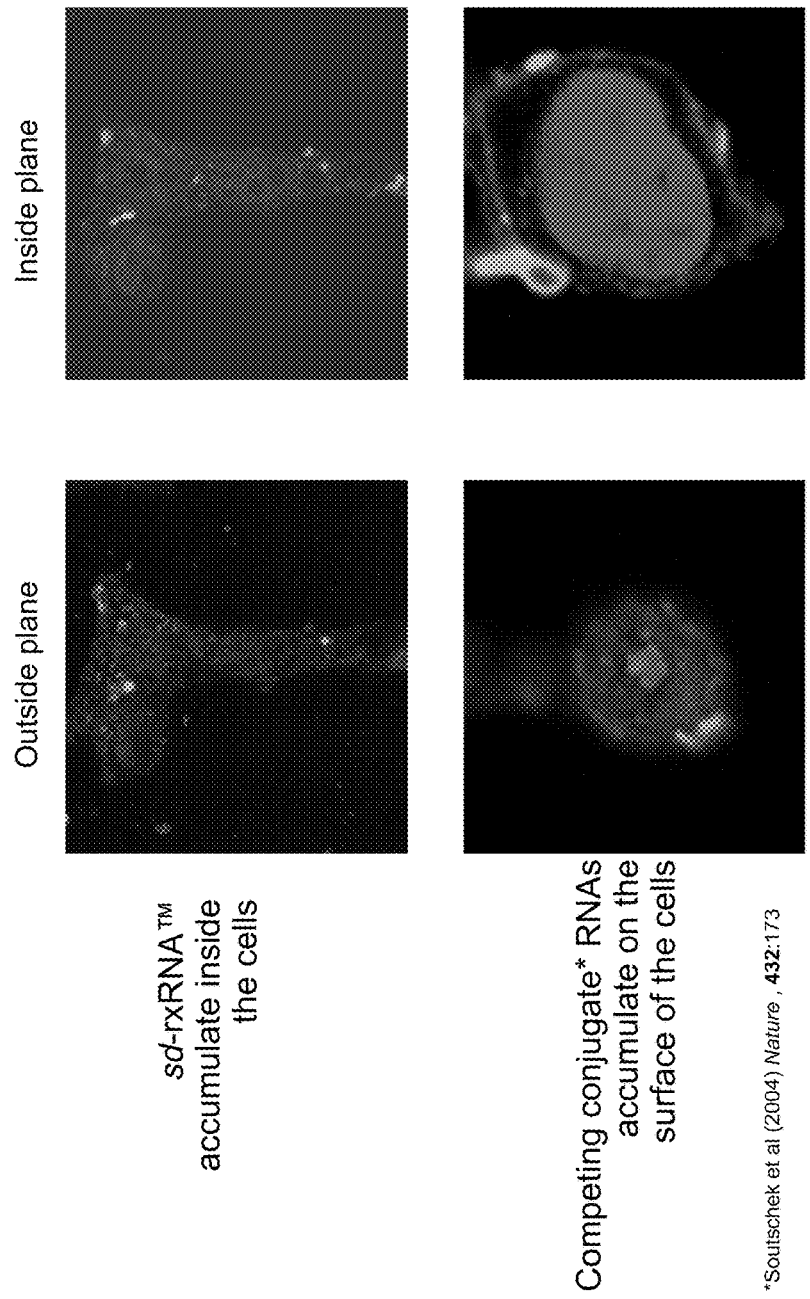
FIG. 63 presents images showing that sd-rxRNA accumulates inside cells while other less effective conjugate RNAs accumulate on the surface of cells.
Figure 66:
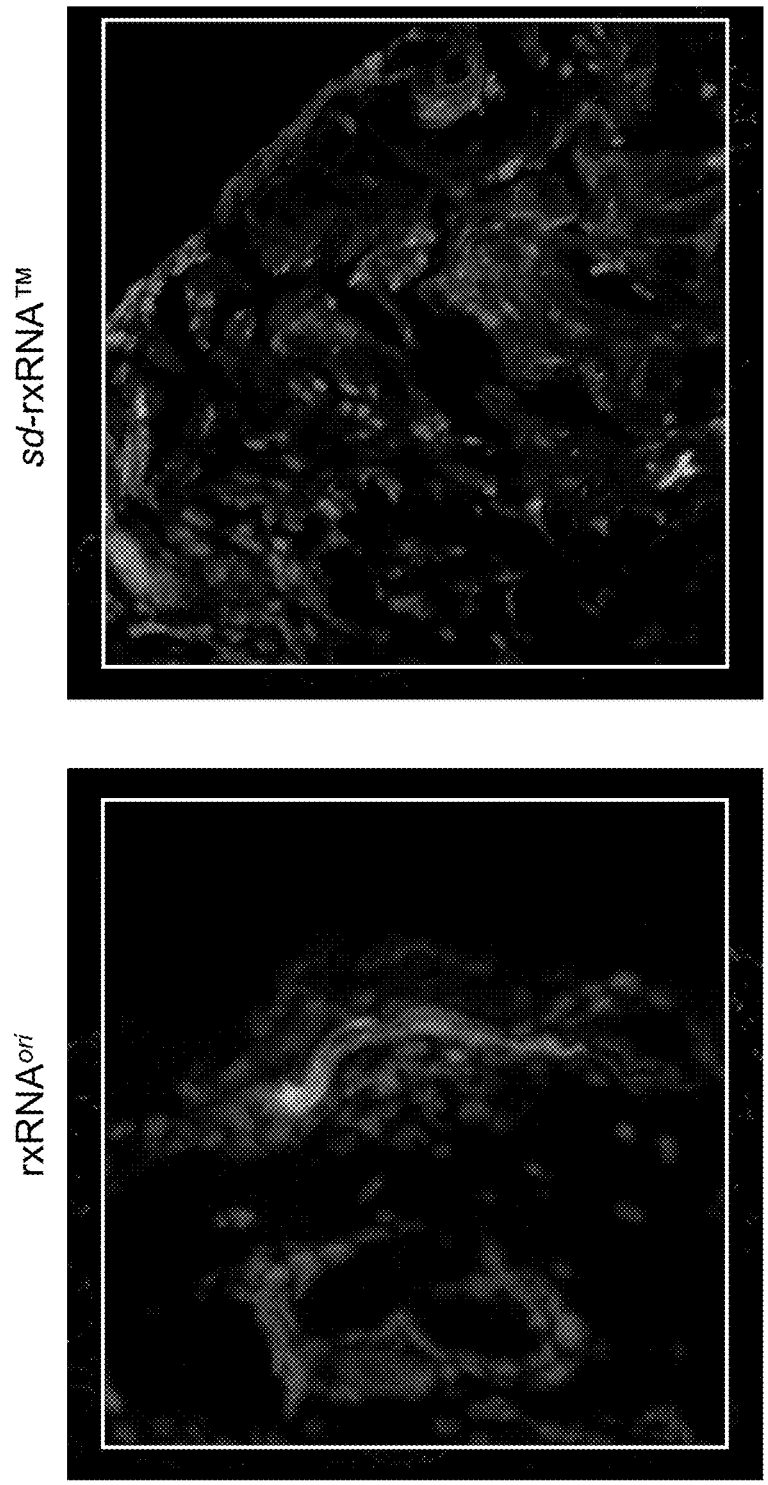
FIG. 66 presents images depicting localization of rxRNA$^{ori}$ and sd-rxRNA following local delivery.
Figure 67:
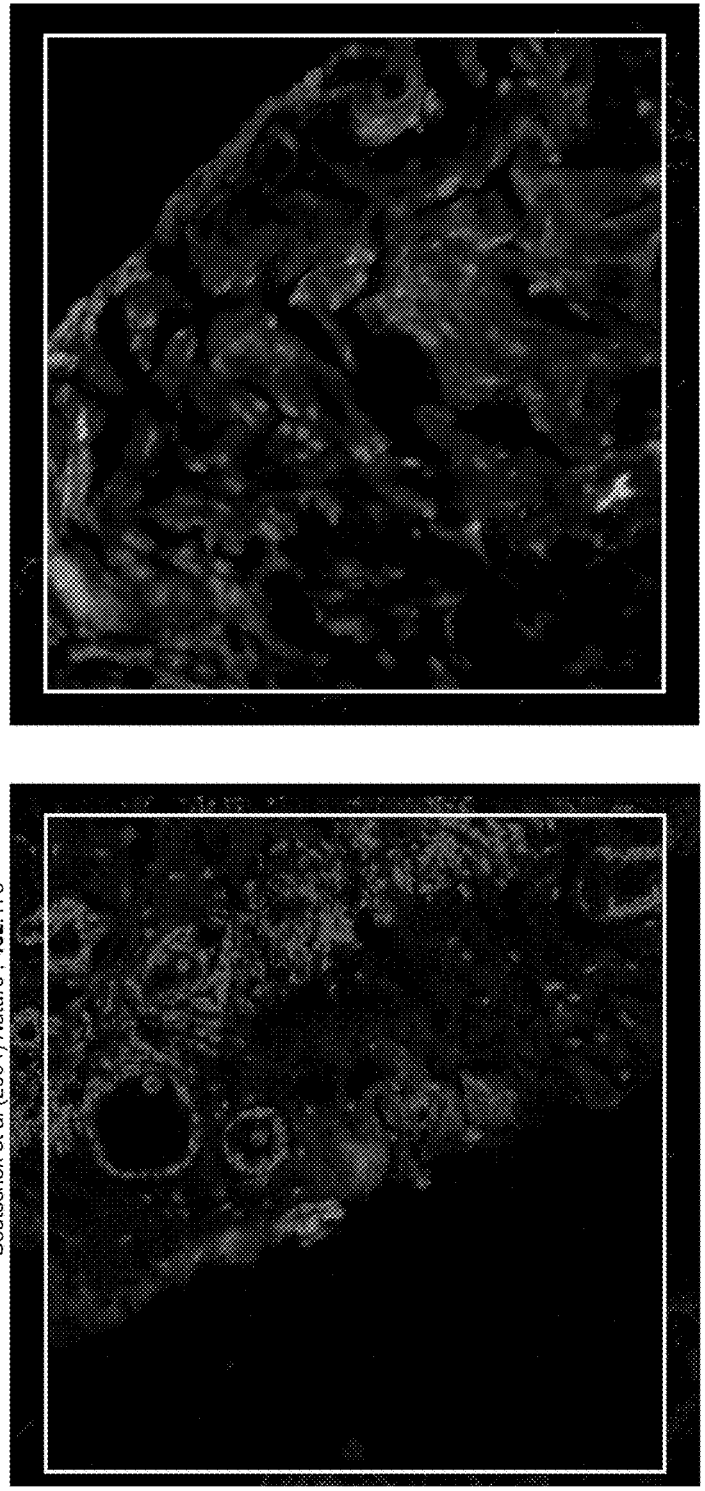
FIG. 67 presents images depicting localization of sd-rxRNA and other conjugate RNAs following local delivery.

FIG. 63 shows localization of sd-rxRNA molecules developed herein compared to localization of other RNA molecules such as those described in Soutschek et al. (2004) Nature, 432:173. sd-rxRNA molecules accumulate inside the cells whereas competing conjugate RNAs accumulate on the surface of cells. Significantly, FIG. 64 shows that sd-rxRNA molecules, but not competitor molecules such as those described in Soutschek et al. are internalized within minutes. FIG. 65 compares localization of sd-rxRNA molecules compared to regular siRNA-cholesterol, as described in Soutschek et al. A signal representing the RNA molecule is clearly detected for the sd-rxRNA molecule in tissue culture RPE cells, following local delivery to compromised skin, and following systemic delivery where uptake to the liver is seen. In each case, no signal is detected for the regular siRNA-cholesterol molecule. The sd-rxRNA molecule thus has drastically better cellular and tissue uptake characteristics when compared to conventional cholesterol conjugated siRNAs such as those described in Soutschek et al. The level of uptake is at least order of magnitude higher and is due at least in part to the unique combination of chemistries and conjugated structure. Superior delivery of sd-rxRNA relative to previously described RNA molecules is also demonstrated in FIGS. 66 and 67.

Based on the analysis of 2nd generation RNA molecules associated with the invention, a screen was performed to identify functional molecules for targeting the SPP1/PPIB gene. As revealed in FIG. 68, several effective molecules were identified, with 14131 being the most effective. The compounds were added to A-549 cells and then the level of SPP1/PPIB ratio was determined by B-DNA after 48 hours.

Figure 69:
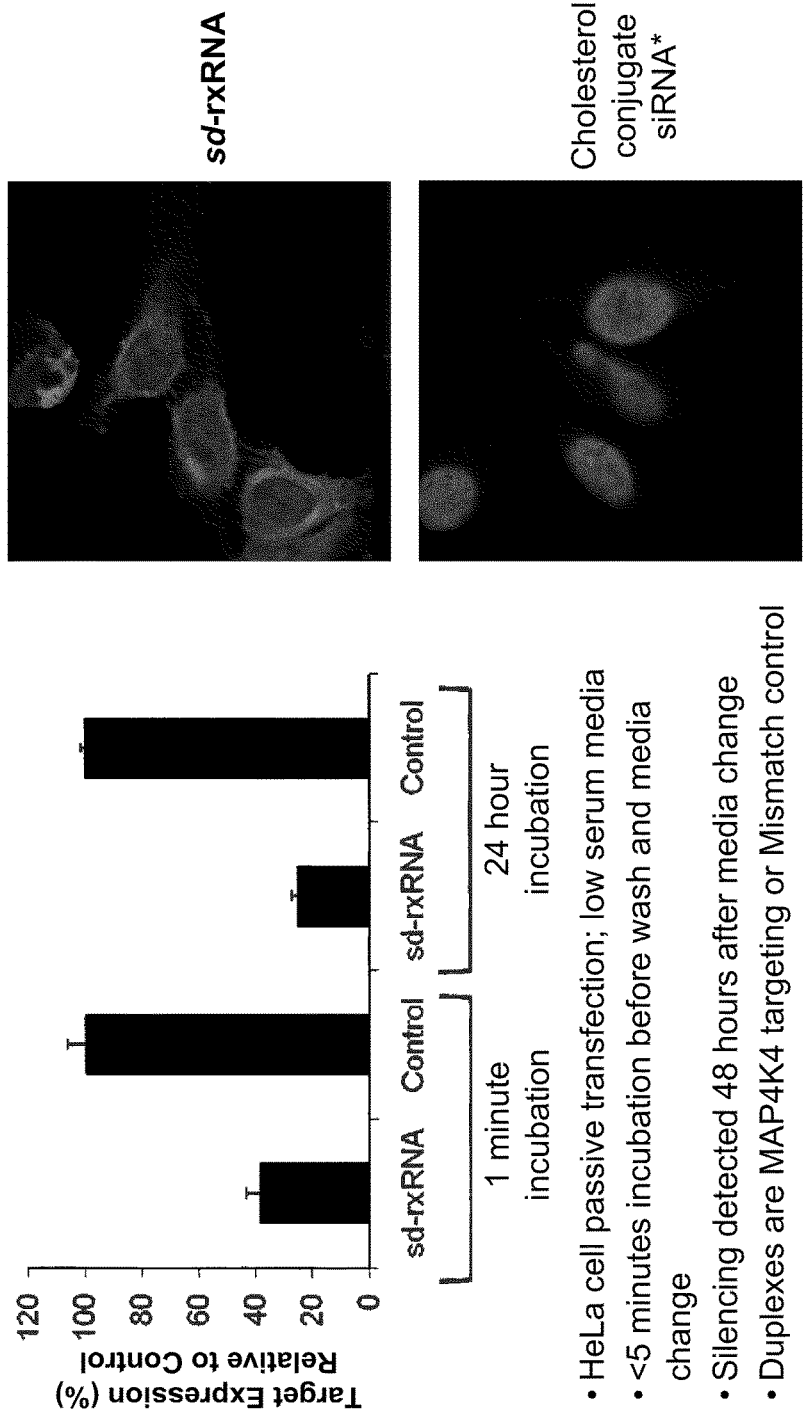
FIG. 69 presents a graph and several images demonstrating efficient cellular uptake of sd-rxRNA within minutes of exposure. This is a unique characteristics of the sd-rxRNA compounds described herein, not observed with any other RNAi compounds. The Soutschek et al. compound was used as a negative control.

FIG. 69 reveals efficient cellular uptake of sd-rxRNA within minutes of exposure. This is a unique characteristics of these molecules, not observed with any other RNAi compounds. Compounds described in Soutschek et al. were used as negative controls. FIG. 70 reveals that the uptake and gene silencing of the sd-rxRNA is effective in multiple different cell types including SH-SY5Y neuroblastoma derived cells, ARPE-19 (retinal pigment epithelium) cells, primary hepatocytes, and primary macrophages. In each case silencing was confirmed by looking at target gene expression by a Branched DNA assay.

FIG. 70 reveals that sd-rxRNA is active in the presence or absence of serum. While a slight reduction in efficacy (2-5 fold) was observed in the presence of serum, this small reduction in efficacy in the presence of serum differentiate the sd-rxRNA molecules from previously described molecules which exhibited a larger reduction in efficacy in the presence of serum. This demonstrated level of efficacy in the presence of serum creates a foundation for in vivo efficacy.

Figure 74:
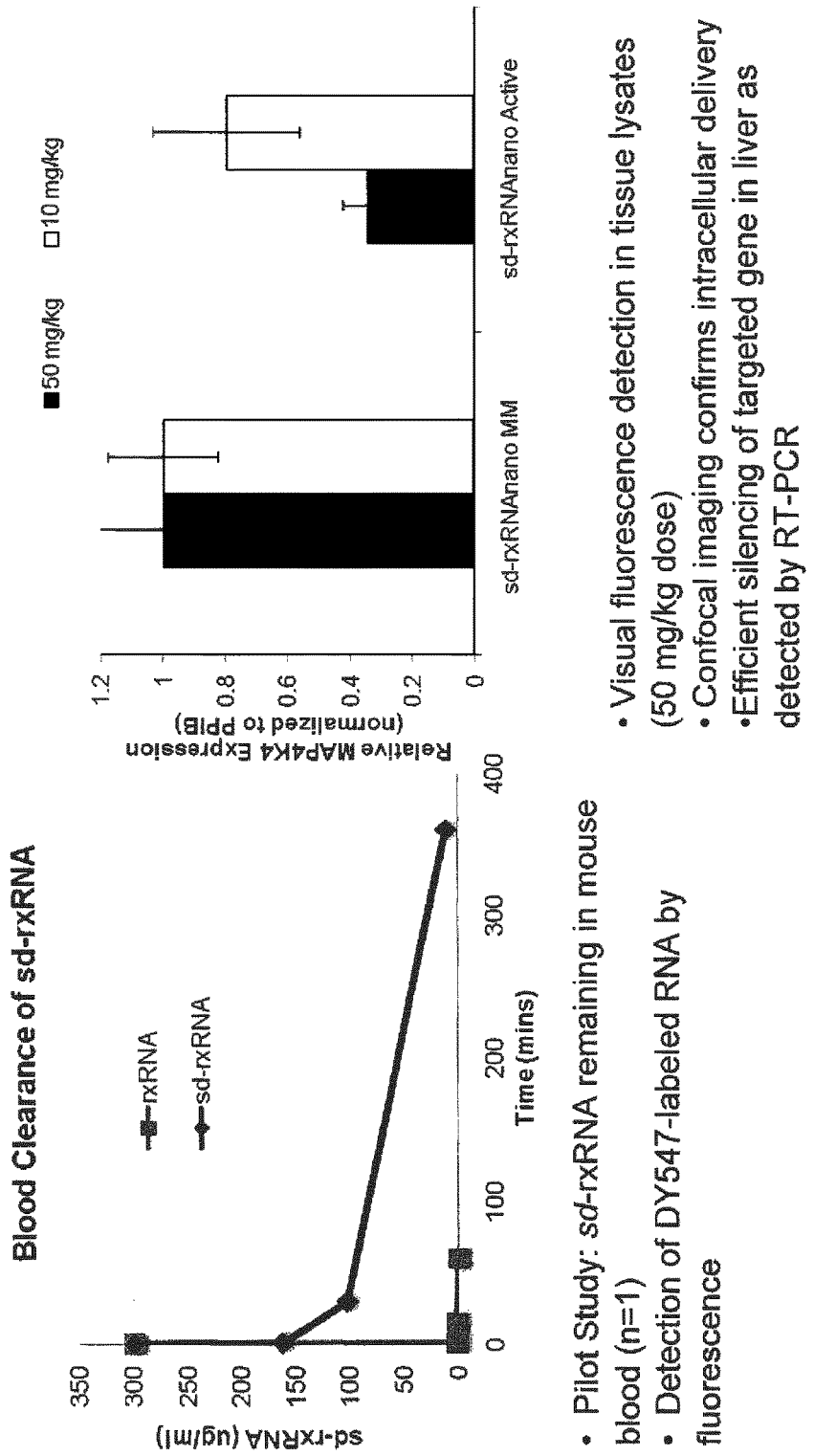
FIG. 74 presents graphs demonstrating that sd-rxRNA compounds have improved blood clearance and induce effective gene silencing in vivo in the liver upon systemic administration.

FIG. 72 reveals efficient tissue penetration and cellular uptake upon single intradermal injection. This data indicates the potential of the sd-rxRNA compounds described herein for silencing genes in any dermatology applications, and also represents a model for local delivery of sd-rxRNA compounds. FIG. 73 also demonstrates efficient cellular uptake and in vivo silencing with sd-rxRNA following intradermal injection. Silencing is determined as the level of MAP4K4 knockdown in several individual biopsies taken from the site of injection as compared to biopsies taken from a site injected with a negative control. FIG. 74 reveals that sd-rxRNA compounds has improved blood clearance and induced effective gene silencing in vivo in the liver upon systemic administration. In comparison to the RNA molecules described by Soutschek et al., the level of liver uptake at identical dose level is at least 50 fold higher with the sd-rxRNA molecules. The uptake results in productive silencing. sd-rxRNA compounds are also characterized by improved blood clearance kinetics.

Figure 75:
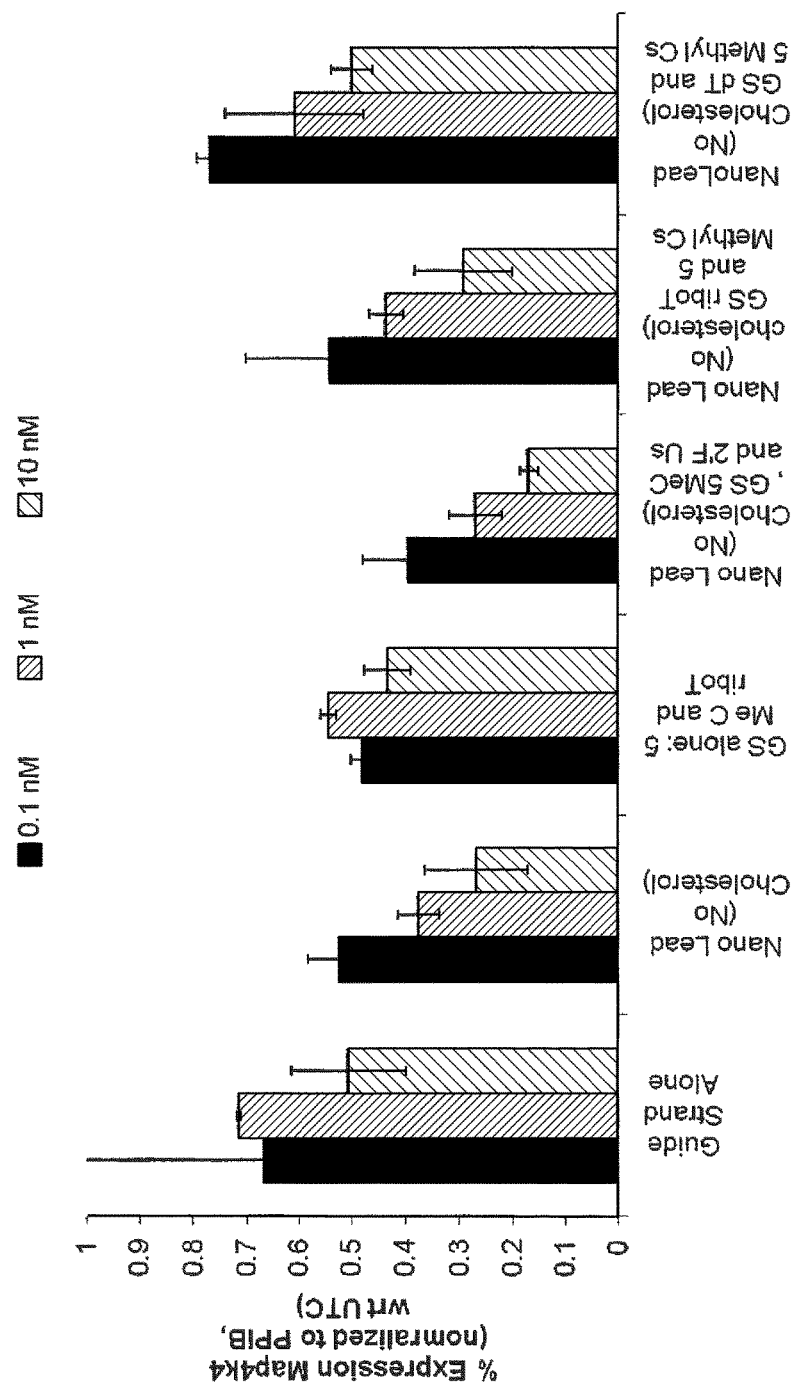
FIG. 75 presents a graph demonstrating that the presence of 5-Methyl C in an RNAi compound resulted in an increase in potency of lipid mediated transfection, demonstrating that hydrophobic modification of Cs and Us in the content of RNAi compounds can be beneficial. In some embodiments, these types of modifications can be used in the context of 2' ribose modified bases to insure optimal stability and efficacy.
Figure 76:
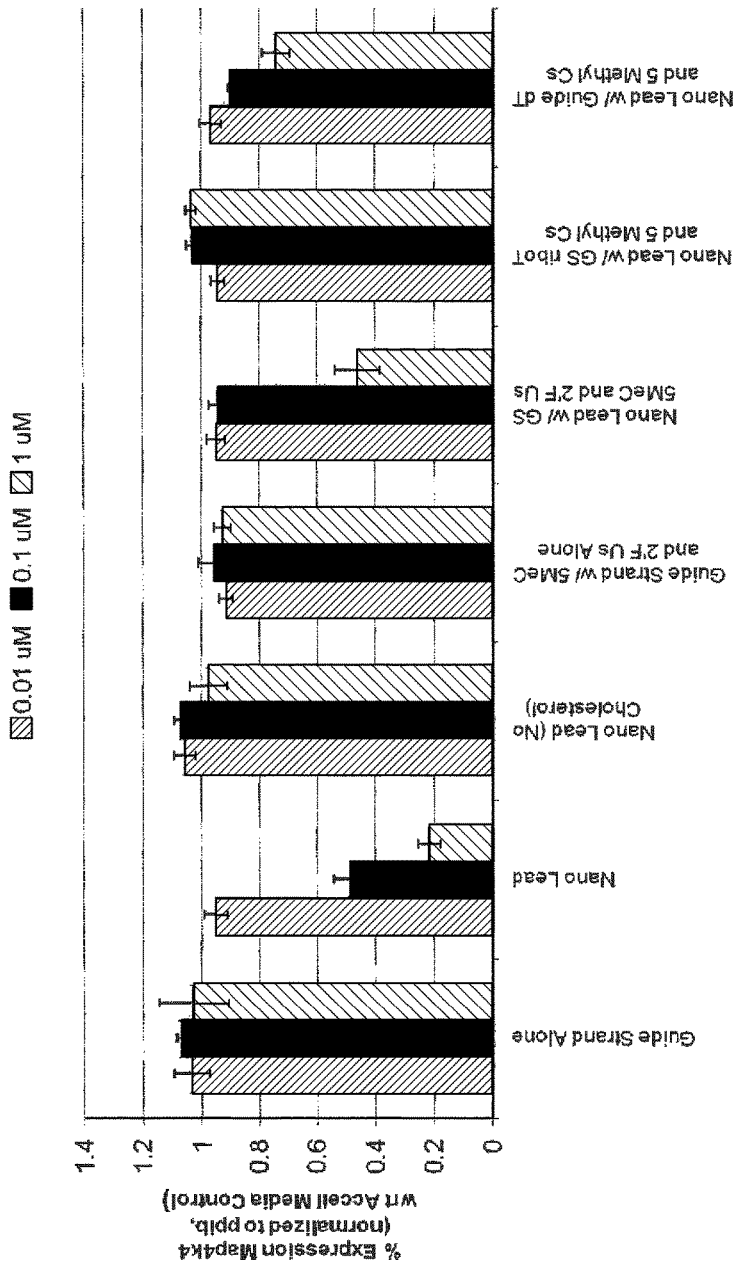
FIG. 76 presents a graph showing percent MAP4K4 expression in HeLa cells following passive uptake transfection of: Guide strand alone; Nano Lead; Nano Lead (No cholesterol); Guide Strand w/5MeC and 2'F Us Alone; Nano Lead w/GS 5MeC and 2'F Us; Nano Lead w/GS riboT and 5 Methyl Cs; and Nano Lead w/Guide dT and 5 Methyl Cs.

The effect of 5-Methyl C modifications was also examined. FIG. 75 demonstrates that the presence of 5-Methyl C in an RNAi molecule resulted in increased potency in lipid mediated transfection. This suggests that hydrophobic modification of Cs and Us in an RNAi molecule can be beneficial. These types of modifications can also be used in the context 2' ribose modified bases to ensure optimal stability and efficacy. FIG. 76 presents data showing that incorporation of 5-Methyl C and/or ribothymidine in the guide strand can in some instances reduce efficacy.

FIG. 77 reveals that sd-rxRNA molecules are more effective than competitor molecules such as molecules described in Soutschek et al., in systemic delivery to the liver. A signal representing the RNA molecule is clearly visible in the sample containing sd-rxRNA, while no signal representing the RNA molecule is visible in the sample containing the competitor RNA molecule.

Figure 78:
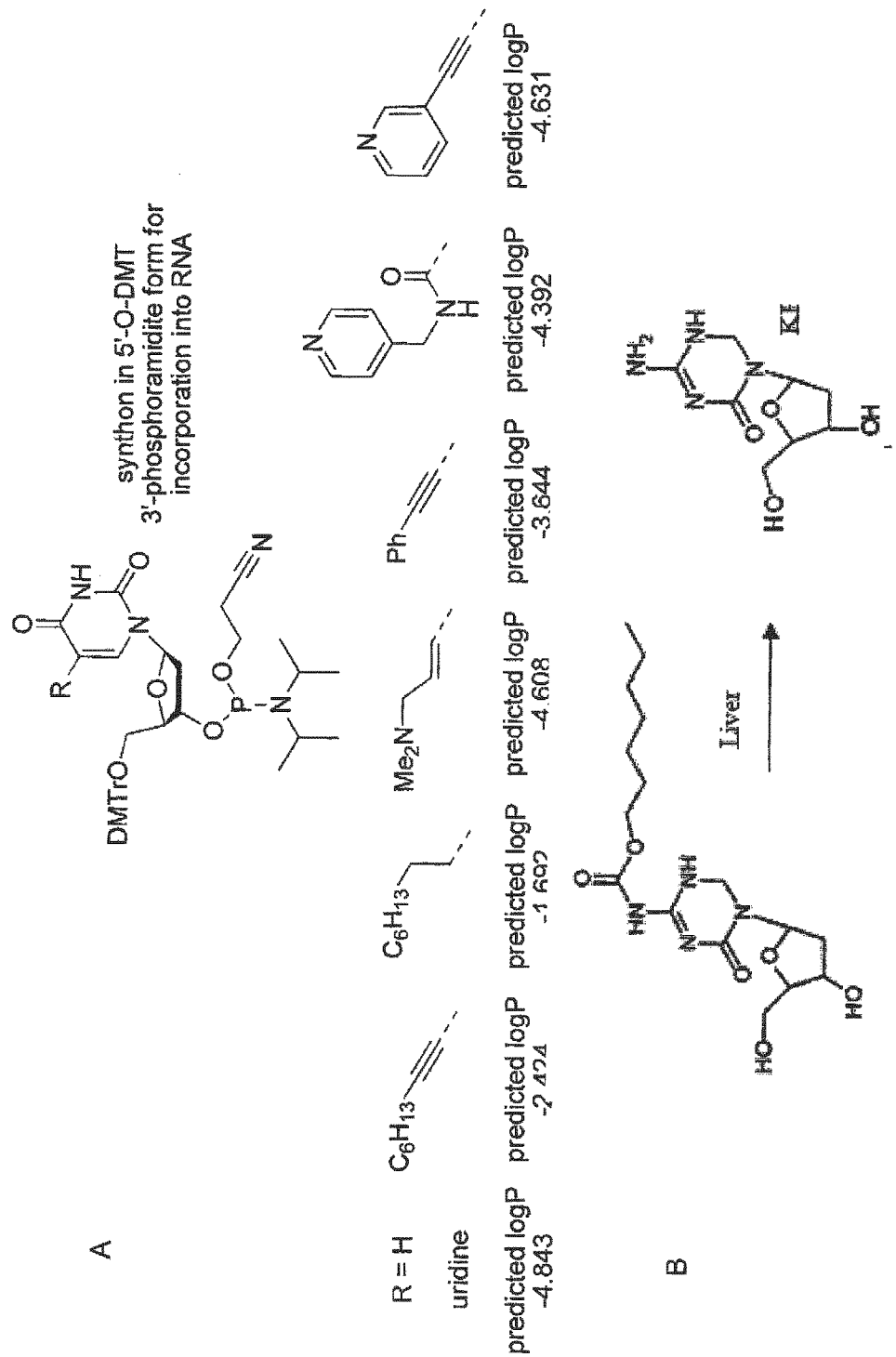
FIG. 78 presents schematics demonstrating 5-uridyl modifications with improved hydrophobicity characteristics. Incorporation of such modifications into sd-rxRNA compounds can increase cellular and tissue uptake properties.
Figure 79:
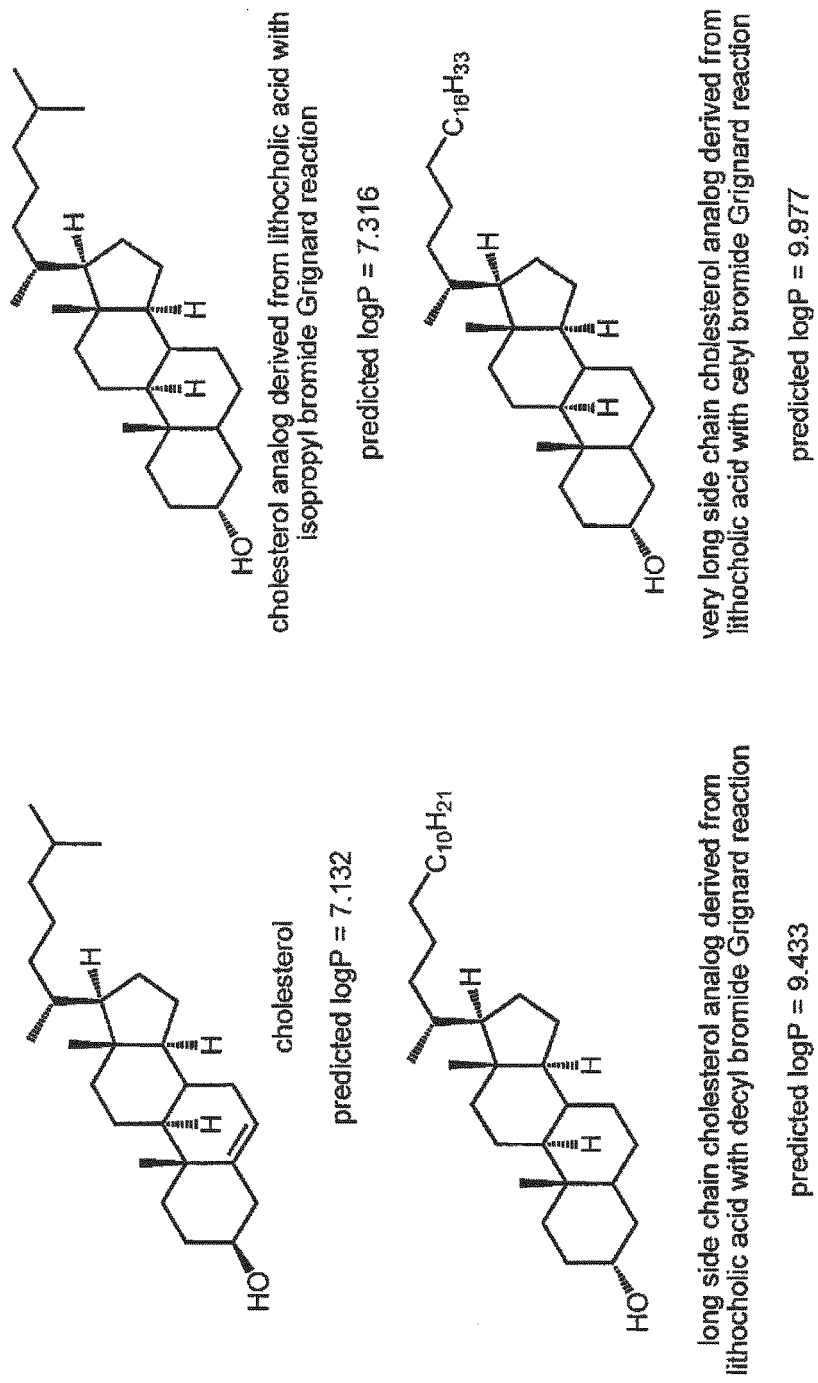
FIG. 79 presents schematics revealing the structures of synthesized modified sterol type molecules, where the length and structure of the C17 attached tail is modified. Without wishing to be bound by any theory, the length of the C17 attached tail may contribute to improving in vitro and in vivo efficacy of sd-rxRNA compounds.

The addition of hydrophobic conjugates to the sd-rxRNA molecules was also explored (FIGS. 78-83). FIG. 78 presents schematics demonstrating 5-uridyl modifications with improved hydrophobicity characteristics. Incorporation of such modifications into sd-rxRNA compounds can increase cellular and tissue uptake properties. FIG. 78B presents a new type of RNAi compound modification which can be applied to compounds to improve cellular uptake and pharmacokinetic behavior. Significantly, this type of modification, when applied to sd-rxRNA compounds, may contribute to making such compounds orally available. FIG. 79 presents schematics revealing the structures of synthesized modified sterol-type molecules, where the length and structure of the C17 attached tail is modified. Without wishing to be bound by any theory, the length of the C17 attached tail may contribute to improving in vitro and in vivo efficacy of sd-rxRNA compounds.

Figure 80:
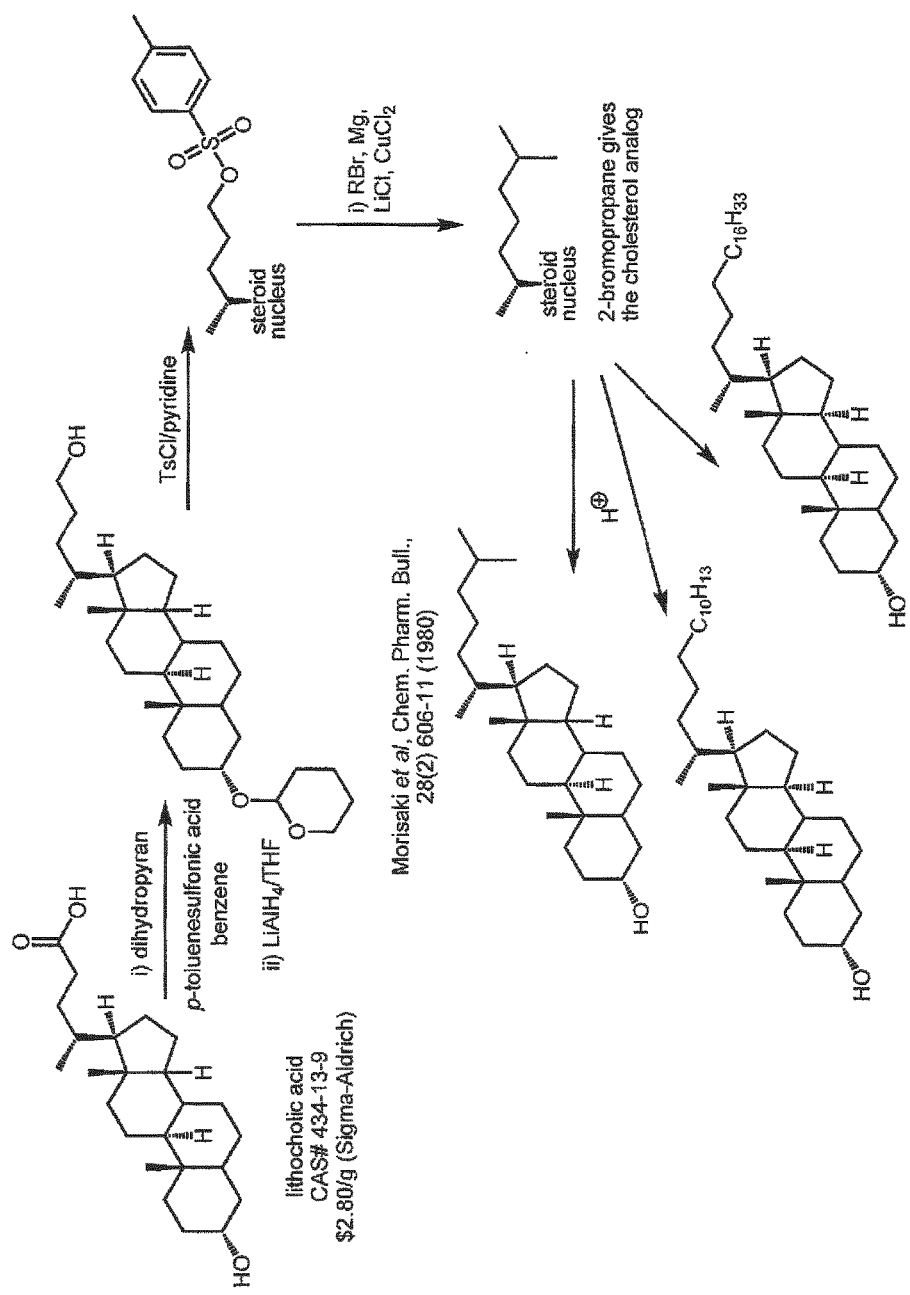
FIG. 80 presents a schematic demonstrating the lithocholic acid route to long side chain cholesterols.
Figure 81:
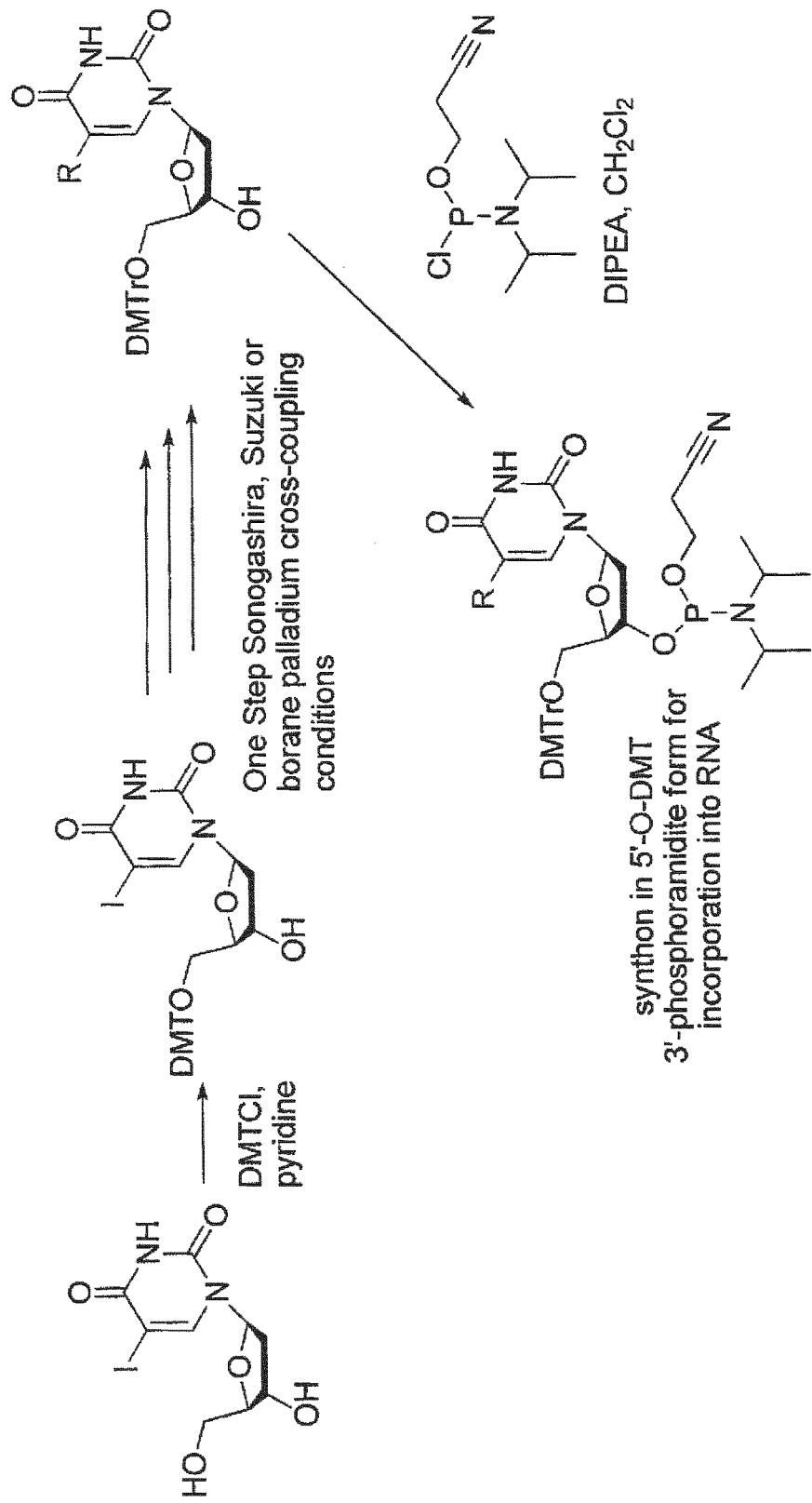
FIG. 81 presents a schematic demonstrating a route to 5-uridyl phosphoramidite synthesis.
Figure 82:
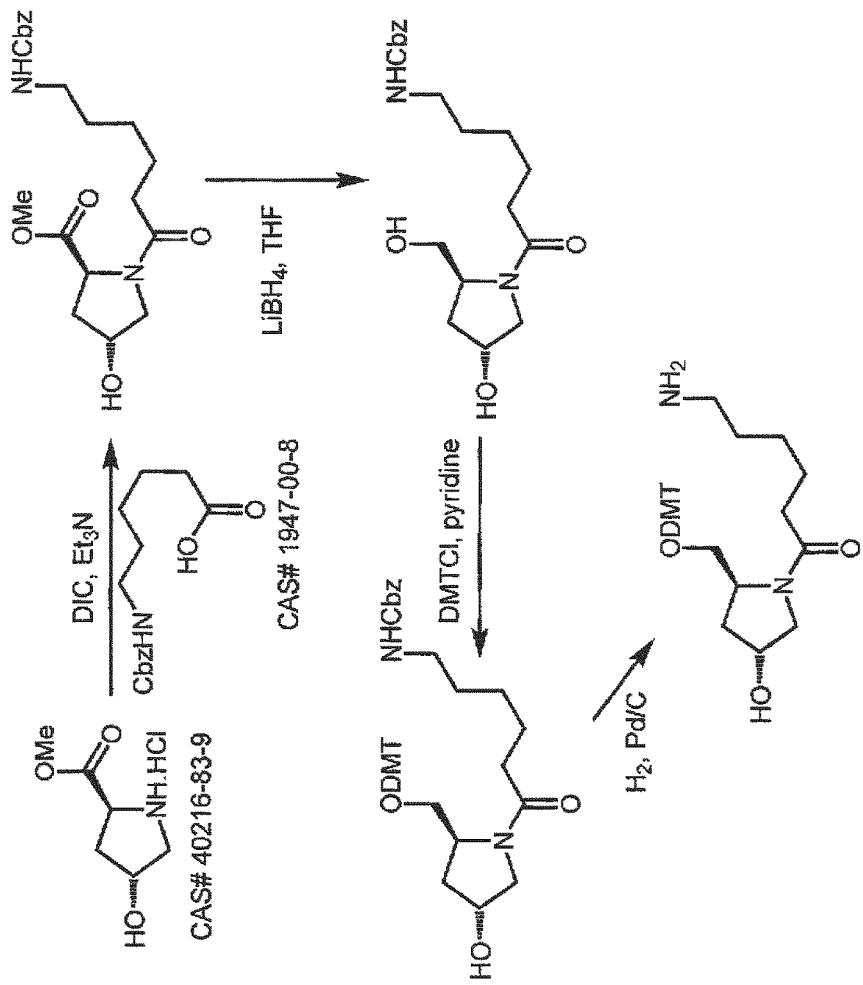
FIG. 82 presents a schematic demonstrating synthesis of tri-functional hydroxyprolinol linker for 3'-cholesterol attachment.
Figure 83:
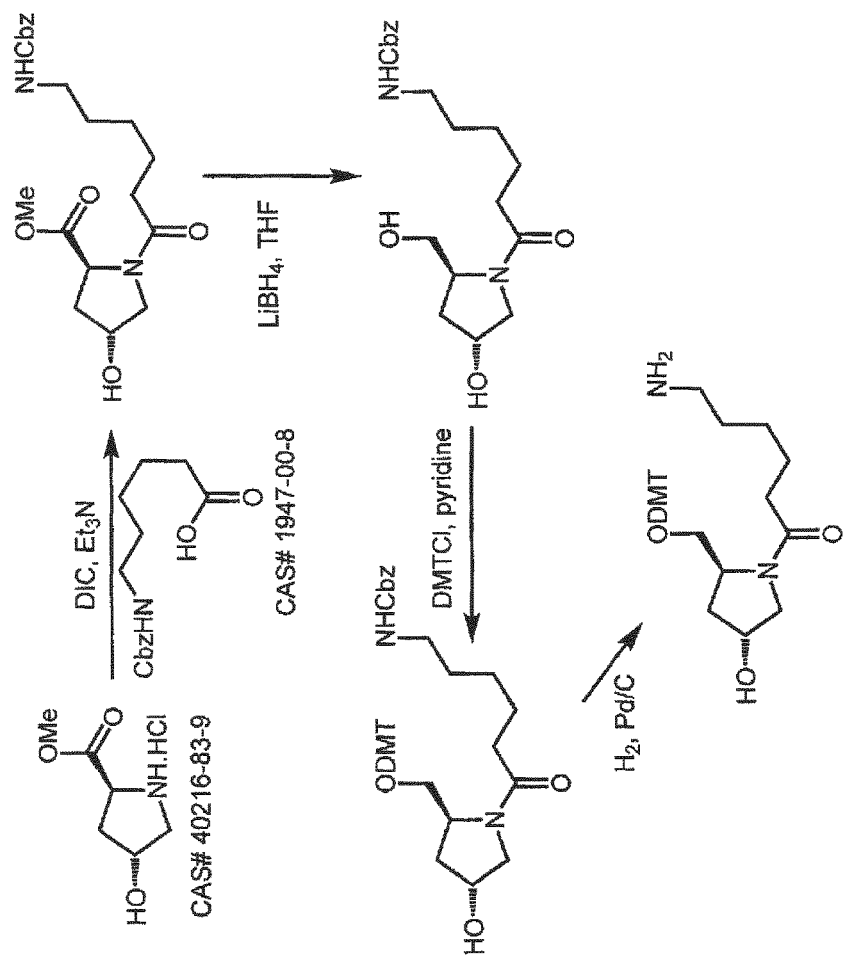
FIG. 83 presents a schematic demonstrating synthesis of solid support for the manufacture of a shorter asymmetric RNAi compound strand.

FIG. 80 presents a schematic demonstrating the lithocholic acid route to long side chain cholesterols. FIG. 81 presents a schematic demonstrating a route to 5-uridyl phosphoramidite synthesis. FIG. 82 presents a schematic demonstrating synthesis of tri-functional hydroxyprolinol linker for 3'-cholesterol attachment. FIG. 83 presents a schematic demonstrating synthesis of solid support for the manufacture of a shorter asymmetric RNAi compound strand.

Figure 84:
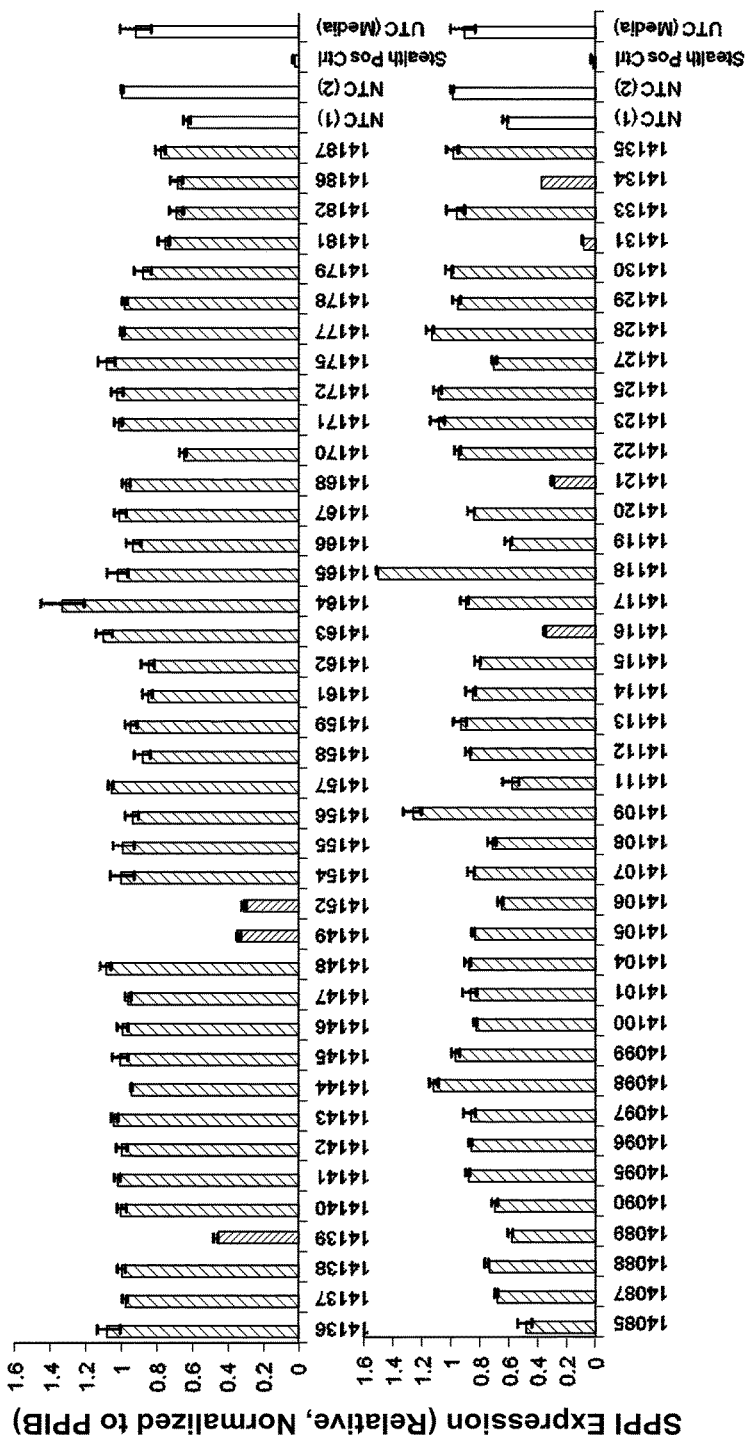
FIG. 84 demonstrates SPPI sd-rxRNA compound selection. Sd-rxRNA compounds targeting SPP1 were added to A549 cells (using passive transfection) and the level of SPP1 expression was evaluated after 48 hours. Several novel compounds effective in SPP1 silencing were identified, the most potent of which was compound 14131.
Figure 85:
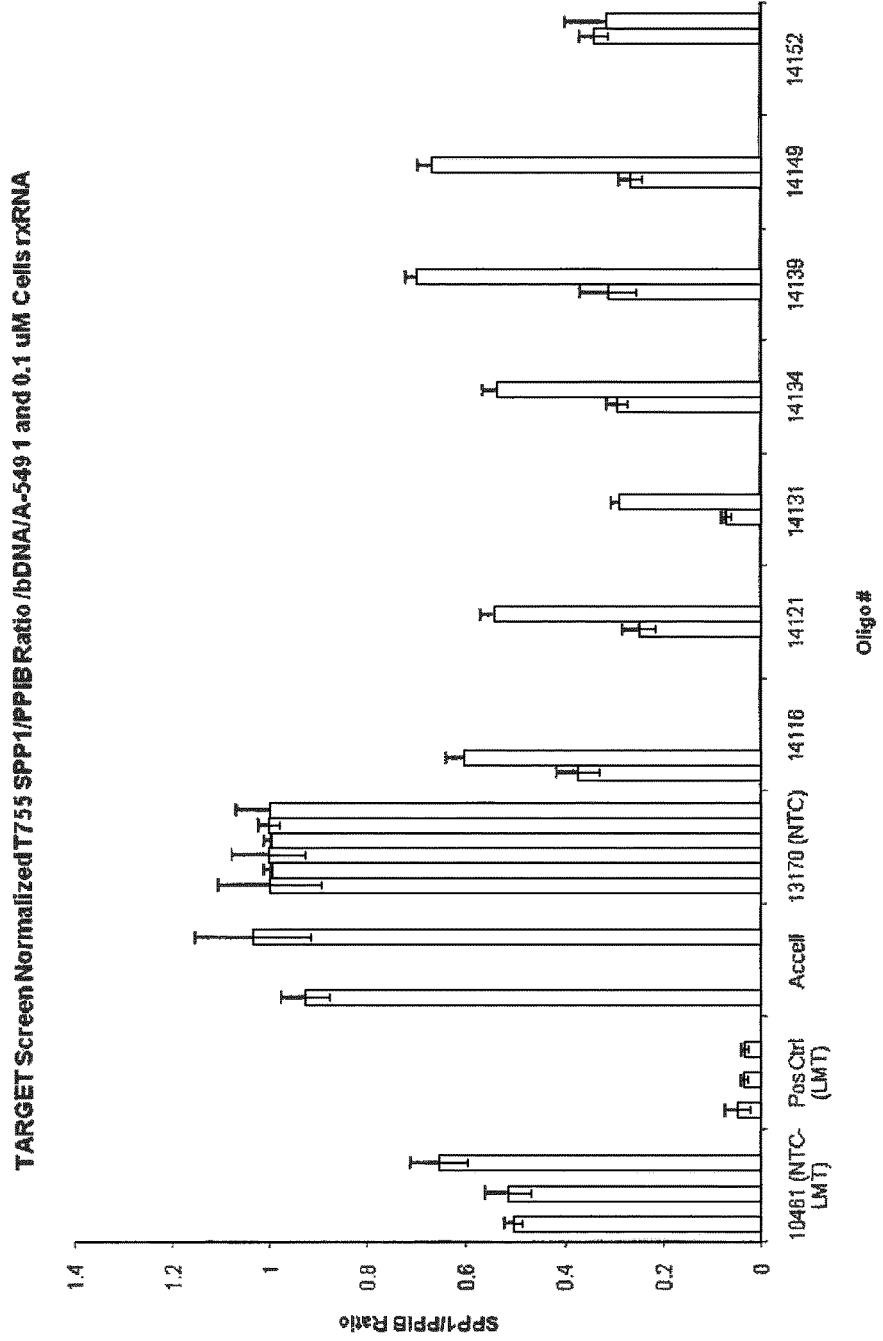
FIG. 85 demonstrates independent validation of sd-rxRNA compounds 14116, 14121, 14131, 14134, 14139, 14149, and 14152 efficacy in SPP1 silencing.
Figure 86:
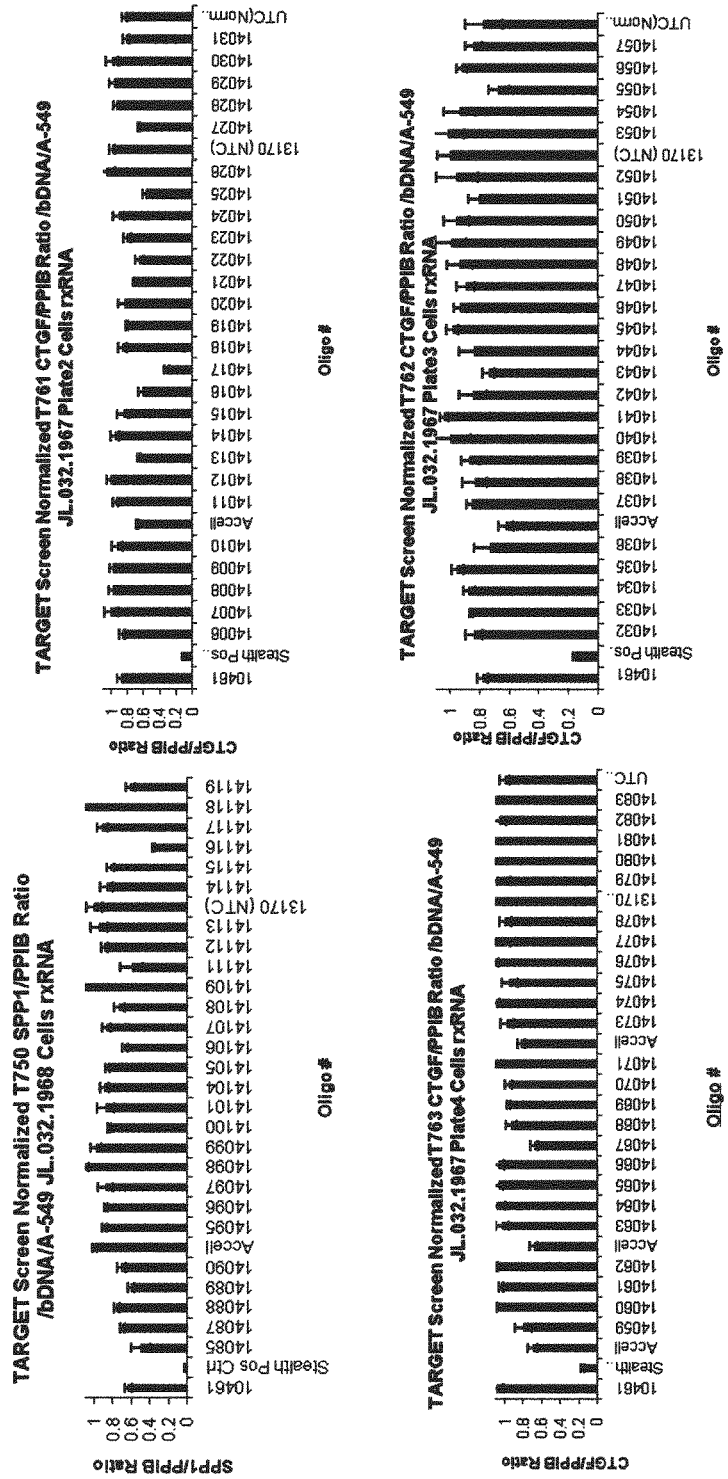
FIG. 86 demonstrates results of sd-rxRNA compound screens to identify sd-rxRNA compounds functional in CTGF knockdown.

A screen was conducted to identify compounds that could effectively silence expression of SPP1 (Osteopontin). Compounds targeting SPP1 were added to A549 cells (using passive transfection), and the level of SPP1 expression was evaluated at 48 hours. Several novel compounds effective in SPP1 silencing were identified. Compounds that were effective in silencing of SPP1 included 14116, 14121, 14131, 14134, 14139, 14149, and 14152 (FIGS. 84-86). The most potent compound in this assay was 14131 (FIG. 84). The efficacy of these sd-rxRNA compounds in silencing SPP1 expression was independently validated (FIG. 85).

Figure 87:
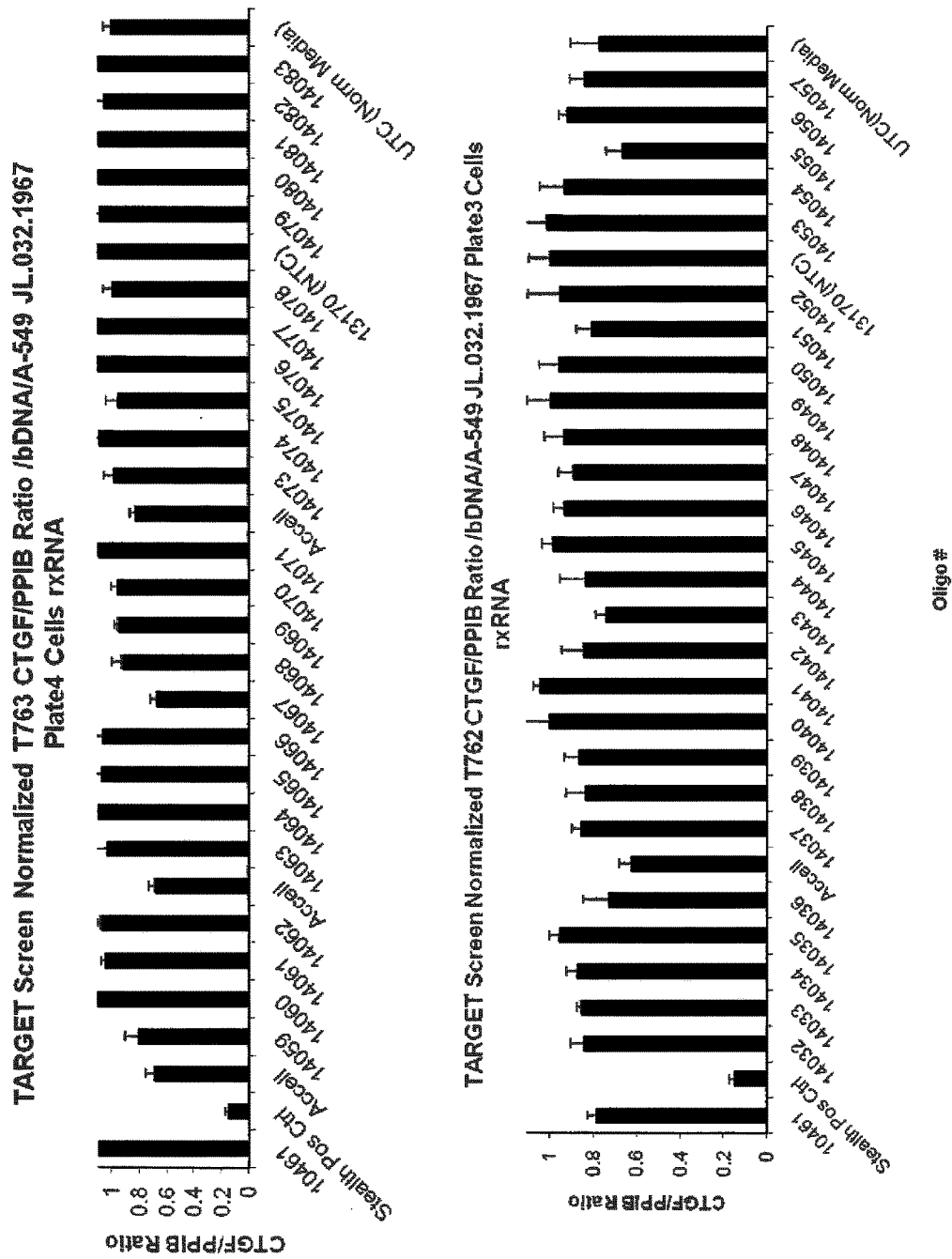
FIG. 87 demonstrates results of sd-rxRNA compound screens to identify sd-rxRNA functional in CTGF knockdown.

A similar screen was conducted to identify compounds that could effectively silence expression of CTGF (FIGS. 86-87). Compounds that were effective in silencing of CTGF included 14017, 14013, 14016, 14022, 14025, 14027.

Methods

Transfection of sd-rxRNA$^{nano}$

Lipid Mediated Transfection sd-rxRNA$^{nano}$ constructs were chemically synthesized (Dharmacon, Lafayette, Colo.) and transfected into HEK293 cells (ATCC, Manassas, Va.) using Lipofectamine RNAiMAX (Invitrogen, Carlsbad, Calif.) according to the manufacturer's instructions. In brief, RNA was diluted to a 12× concentration in Opti-MEM®1 Reduced Serum Media (Invitrogen, Carlsbad, Calif.) and then combined with a 12× concentration of Lipofectamine RNAiMAX. The RNA and transfection reagent were allowed to complex at room temperature for 20 minutes and make a 6× concentration. While complexing, HEK293 cells were washed, trypsinized and counted. The cells were diluted to a concentration recommended by the manufacturer and previously described of 1×10$^5$ cells/ml. When RNA had completed complexing with the RNAiMAX transfection reagent, 20 ul of the complexes were added to the appropriate well of the 96-well plate in triplicate. Cells were added to each well (100 ul volume) to make the final cell count per well 1×10$^4$ cells/well. The volume of cells diluted the 6× concentration of complex to 1× (between 10-0.05 nM). Cells were incubated for 24 or 48 hours under normal growth conditions. After 24 or 48 hour incubation, cells were lysed and gene silencing activity was measured using the QuantiGene assay (Panomics, Freemont, Calif.) which employs bDNA hybridization technology. The assay was carried out according to manufacturer's instructions.

Passive Uptake Transfection sd-rxRNA$^{nano}$ constructs were chemically synthesized (Dharmacon, Lafayette, Colo.). 24 hours prior to transfection, HeLa cells (ATCC, Manassas, Va.) were plated at 1×10$^4$ cells/well in a 96 well plate under normal growth conditions (DMEM, 10% FBS and 1% Penicillin and Streptomycin). Prior to transfection of HeLa cells, sd-rxRNA$^{nano}$ were diluted to a final concentration of 0.01 uM to 1 uM in Accell siRNA Delivery Media (Dharmacon, Lafayette, Colo.). Normal growth media was aspirated off cells and 100 uL of Accell Delivery media containing the appropriate concentration of sd-rxRNA$^{nano}$ was applied to the cells. 48 hours post transfection, delivery media was aspirated off the cells and normal growth media was applied to cells for an additional 24 hours.

After 48 or 72 hour incubation, cells were lysed and gene silencing activity was measured using the QuantiGene assay (Panomics, Freemont, Calif.) according to manufacturer's instructions.

TABLE 1

| ID Number | Oligo Number | Accession number | Gene Name | Gene Symbol |
|---|---|---|---|---|
| APOB-10167-20-12138 | 12138 | NM_000384 | Apolipoprotein B (including Ag(x) antigen) | APOB |
| APOB-10167-20-12139 | 12139 | NM_000384 | Apolipoprotein B (including Ag(x) antigen) | APOB |
| MAP4K4-2931-13-12266 | 12266 | NM_004834 | Mitogen-Activated Protein Kinase Kinase Kinase Kinase 4 (MAP4K4), transcript variant 1 | MAP4K4 |
| MAP4K4-2931-16-12293 | 12293 | NM_004834 | Mitogen-Activated Protein Kinase Kinase Kinase Kinase 4 (MAP4K4), transcript variant 1 | MAP4K4 |
| MAP4K4-2931-16-12383 | 12383 | NM_004834 | Mitogen-Activated Protein Kinase Kinase Kinase Kinase 4 (MAP4K4), transcript variant 1 | MAP4K4 |
| MAP4K4-2931-16-12384 | 12384 | NM_004834 | Mitogen-Activated Protein Kinase Kinase Kinase Kinase 4 (MAP4K4), transcript variant 1 | MAP4K4 |
| MAP4K4-2931-16-12385 | 12385 | NM_004834 | Mitogen-Activated Protein Kinase Kinase Kinase Kinase 4 (MAP4K4), transcript variant 1 | MAP4K4 |
| MAP4K4-2931-16-12386 | 12386 | NM_004834 | Mitogen-Activated Protein Kinase Kinase Kinase Kinase 4 (MAP4K4), transcript variant 1 | MAP4K4 |
| MAP4K4-2931-16-12387 | 12387 | NM_004834 | Mitogen-Activated Protein Kinase Kinase Kinase Kinase 4 (MAP4K4), transcript variant 1 | MAP4K4 |
| MAP4K4-2931-15-12388 | 12388 | NM_004834 | Mitogen-Activated Protein Kinase Kinase Kinase Kinase 4 (MAP4K4), transcript variant 1 | MAP4K4 |
| MAP4K4-2931-13-12432 | 12432 | NM_004834 | Mitogen-Activated Protein Kinase Kinase Kinase Kinase 4 (MAP4K4), transcript variant 1 | MAP4K4 |
| MAP4K4-2931-13-12266.2 | 12266.2 | NM_004834 | Mitogen-Activated Protein Kinase Kinase Kinase Kinase 4 (MAP4K4), transcript variant 1 | MAP4K4 |
| APOB--21-12434 | 12434 | NM_000384 | Apolipoprotein B (including Ag(x) antigen) | APOB |
| APOB--21-12435 | 12435 | NM_000384 | Apolipoprotein B (including Ag(x) antigen) | APOB |
| MAP4K4-2931-16-12451 | 12451 | NM_004834 | Mitogen-Activated Protein Kinase Kinase Kinase Kinase 4 (MAP4K4), transcript variant 1 | MAP4K4 |
| MAP4K4-2931-16-12452 | 12452 | NM_004834 | Mitogen-Activated Protein Kinase Kinase Kinase Kinase 4 (MAP4K4), transcript variant 1 | MAP4K4 |
| MAP4K4-2931-16-12453 | 12453 | NM_004834 | Mitogen-Activated Protein Kinase Kinase Kinase Kinase 4 (MAP4K4), transcript variant 1 | MAP4K4 |
| MAP4K4-2931-17-12454 | 12454 | NM_004834 | Mitogen-Activated Protein Kinase Kinase Kinase Kinase 4 (MAP4K4), transcript variant 1 | MAP4K4 |
| MAP4K4-2931-17-12455 | 12455 | NM_004834 | Mitogen-Activated Protein Kinase Kinase Kinase Kinase 4 (MAP4K4), transcript variant 1 | MAP4K4 |
| MAP4K4-2931-19-12456 | 12456 | NM_004834 | Mitogen-Activated Protein Kinase Kinase Kinase Kinase 4 (MAP4K4), transcript variant 1 | MAP4K4 |
| --27-12480 | 12480 | | | |
| --27-12481 | 12481 | | | |
| APOB-10167-21-12505 | 12505 | NM_000384 | Apolipoprotein B (including Ag(x) antigen) | APOB |
| APOB-10167-21-12506 | 12506 | NM_000384 | Apolipoprotein B (including Ag(x) antigen) | APOB |
| MAP4K4-2931-16-12539 | 12539 | NM_004834 | Mitogen-Activated Protein Kinase Kinase Kinase Kinase 4 (MAP4K4), transcript variant 1 | MAP4K4 |
| APOB-10167-21-12505.2 | 12505.2 | NM_000384 | Apolipoprotein B (including Ag(x) antigen) | APOB |
| APOB-10167-21-12506.2 | 12506.2 | NM_000384 | Apolipoprotein B (including Ag(x) antigen) | APOB |
| MAP4K4--13-12565 | 12565 | | | MAP4K4 |
| MAP4K4-2931-16-12386.2 | 12386.2 | NM_004834 | Mitogen-Activated Protein Kinase Kinase Kinase Kinase 4 (MAP4K4), transcript variant 1 | MAP4K4 |
| MAP4K4-2931-13-12815 | 12815 | NM_004834 | Mitogen-Activated Protein Kinase Kinase Kinase Kinase 4 (MAP4K4), transcript variant 1 | MAP4K4 |

TABLE 1-continued

| ID Number | Oligo Number | Accession number | Gene Name | Gene Symbol |
|---|---|---|---|---|
| APOB--13-12957 | 12957 | NM_000384 | Apolipoprotein B (including Ag(x) antigen) | APOB |
| MAP4K4--16-12983 | 12983 | | Mitogen-Activated Protein Kinase Kinase Kinase Kinase 4 (MAP4K4), transcript variant 1 | MAP4K4 |
| MAP4K4--16-12984 | 12984 | | Mitogen-Activated Protein Kinase Kinase Kinase Kinase 4 (MAP4K4), transcript variant 1 | MAP4K4 |
| MAP4K4--16-12985 | 12985 | | Mitogen-Activated Protein Kinase Kinase Kinase Kinase 4 (MAP4K4), transcript variant 1 | MAP4K4 |
| MAP4K4--16-12986 | 12986 | | Mitogen-Activated Protein Kinase Kinase Kinase Kinase 4 (MAP4K4), transcript variant 1 | MAP4K4 |
| MAP4K4--16-12987 | 12987 | | Mitogen-Activated Protein Kinase Kinase Kinase Kinase 4 (MAP4K4), transcript variant 1 | MAP4K4 |
| MAP4K4--16-12988 | 12988 | | Mitogen-Activated Protein Kinase Kinase Kinase Kinase 4 (MAP4K4), transcript variant 1 | MAP4K4 |
| MAP4K4--16-12989 | 12989 | | Mitogen-Activated Protein Kinase Kinase Kinase Kinase 4 (MAP4K4), transcript variant 1 | MAP4K4 |
| MAP4K4--16-12990 | 12990 | | Mitogen-Activated Protein Kinase Kinase Kinase Kinase 4 (MAP4K4), transcript variant 1 | MAP4K4 |
| MAP4K4--16-12991 | 12991 | | Mitogen-Activated Protein Kinase Kinase Kinase Kinase 4 (MAP4K4), transcript variant 1 | MAP4K4 |
| MAP4K4--16-12992 | 12992 | | Mitogen-Activated Protein Kinase Kinase Kinase Kinase 4 (MAP4K4), transcript variant 1 | MAP4K4 |
| MAP4K4--16-12993 | 12993 | | Mitogen-Activated Protein Kinase Kinase Kinase Kinase 4 (MAP4K4), transcript variant 1 | MAP4K4 |
| MAP4K4--16-12994 | 12994 | | Mitogen-Activated Protein Kinase Kinase Kinase Kinase 4 (MAP4K4), transcript variant 1 | MAP4K4 |
| MAP4K4--16-12995 | 12995 | | Mitogen-Activated Protein Kinase Kinase Kinase Kinase 4 (MAP4K4), transcript variant 1 | MAP4K4 |
| MAP4K4-2931-19-13012 | 13012 | NM_004834 | Mitogen-Activated Protein Kinase Kinase Kinase Kinase 4 (MAP4K4), transcript variant 1 | MAP4K4 |
| MAP4K4-2931-19-13016 | 13016 | NM_004834 | Mitogen-Activated Protein Kinase Kinase Kinase Kinase 4 (MAP4K4), transcript variant 1 | MAP4K4 |
| PPIB--13-13021 | 13021 | NM_000942 | Peptidylprolyl Isomerase B (cyclophilin B) | PPIB |
| pGL3-1172-13-13038 | 13038 | U47296 | Cloning vector pGL3-Control | pGL3 |
| pGL3-1172-13-13040--16-13047 | 13040 13047 | U47296 | Cloning vector pGL3-Control | pGL3 |
| SOD1-530-13-13090 | 13090 | NM_000454 | Superoxide Dismutase 1, soluble (amyotrophic lateral sclerosis 1 (adult)) | SOD1 |
| SOD1-523-13-13091 | 13091 | NM_000454 | Superoxide Dismutase 1, soluble (amyotrophic lateral sclerosis 1 (adult)) | SOD1 |
| SOD1-535-13-13092 | 13092 | NM_000454 | Superoxide Dismutase 1, soluble (amyotrophic lateral sclerosis 1 (adult)) | SOD1 |
| SOD1-536-13-13093 | 13093 | NM_000454 | Superoxide Dismutase 1, soluble (amyotrophic lateral sclerosis 1 (adult)) | SOD1 |
| SOD1-396-13-13094 | 13094 | NM_000454 | Superoxide Dismutase 1, soluble (amyotrophic lateral sclerosis 1 (adult)) | SOD1 |
| SOD1-385-13-13095 | 13095 | NM_000454 | Superoxide Dismutase 1, soluble (amyotrophic lateral sclerosis 1 (adult)) | SOD1 |
| SOD1-195-13-13096 | 13096 | NM_000454 | Superoxide Dismutase 1, soluble (amyotrophic lateral sclerosis 1 (adult)) | SOD1 |
| APOB-4314-13-13115 | 13115 | NM_000384 | Apolipoprotein B (including Ag(x) antigen) | APOB |
| APOB-3384-13-13116 | 13116 | NM_000384 | Apolipoprotein B (including Ag(x) antigen) | APOB |

TABLE 1-continued

| ID Number | Oligo Number | Accession number | Gene Name | Gene Symbol |
|---|---|---|---|---|
| APOB-3547-13-13117 | 13117 | NM_000384 | Apolipoprotein B (including Ag(x) antigen) | APOB |
| APOB-4318-13-13118 | 13118 | NM_000384 | Apolipoprotein B (including Ag(x) antigen) | APOB |
| APOB-3741-13-13119 | 13119 | NM_000384 | Apolipoprotein B (including Ag(x) antigen) | APOB |
| PPIB--16-13136 | 13136 | NM_000942 | Peptidylprolyl Isomerase B (cyclophilin B) | PPIB |
| APOB-4314-15-13154 | 13154 | NM_000384 | Apolipoprotein B (including Ag(x) antigen) | APOB |
| APOB-3547-15-13155 | 13155 | NM_000384 | Apolipoprotein B (including Ag(x) antigen) | APOB |
| APOB-4318-15-13157 | 13157 | NM_000384 | Apolipoprotein B (including Ag(x) antigen) | APOB |
| APOB-3741-15-13158 | 13158 | NM_000384 | Apolipoprotein B (including Ag(x) antigen) | APOB |
| APOB--13-13159 | 13159 | NM_000384 | Apolipoprotein B (including Ag(x) antigen) | APOB |
| APOB--15-13160 | 13160 | NM_000384 | Apolipoprotein B (including Ag(x) antigen) | APOB |
| SOD1-530-16-13163 | 13163 | NM_000454 | Superoxide Dismutase 1, soluble (amyotrophic lateral sclerosis 1 (adult)) | SOD1 |
| SOD1-523-16-13164 | 13164 | NM_000454 | Superoxide Dismutase 1, soluble (amyotrophic lateral sclerosis 1 (adult)) | SOD1 |
| SOD1-535-16-13165 | 13165 | NM_000454 | Superoxide Dismutase 1, soluble (amyotrophic lateral sclerosis 1 (adult)) | SOD1 |
| SOD1-536-16-13166 | 13166 | NM_000454 | Superoxide Dismutase 1, soluble (amyotrophic lateral sclerosis 1 (adult)) | SOD1 |
| SOD1-396-16-13167 | 13167 | NM_000454 | Superoxide Dismutase 1, soluble (amyotrophic lateral sclerosis 1 (adult)) | SOD1 |
| SOD1-385-16-13168 | 13168 | NM_000454 | Superoxide Dismutase 1, soluble (amyotrophic lateral sclerosis 1 (adult)) | SOD1 |
| SOD1-195-16-13169 | 13169 | NM_000454 | Superoxide Dismutase 1, soluble (amyotrophic lateral sclerosis 1 (adult)) | SOD1 |
| pGL3-1172-16-13170 | 13170 | U47296 | Cloning vector pGL3-Control | pGL3 |
| pGL3-1172-16-13171 | 13171 | U47296 | Cloning vector pGL3-Control | pGL3 |
| MAP4k4-2931-19-13189 | 13189 | NM_004834 | Mitogen-Activated Protein Kinase Kinase Kinase Kinase 4 (MAP4K4), transcript variant 1 | MAP4k4 |
| CTGF-1222-13-13190 | 13190 | NM_001901.2 | connective tissue growth factor | CTGF |
| CTGF-813-13-13192 | 13192 | NM_001901.2 | connective tissue growth factor | CTGF |
| CTGF-747-13-13194 | 13194 | NM_001901.2 | connective tissue growth factor | CTGF |
| CTGF-817-13-13196 | 13196 | NM_001901.2 | connective tissue growth factor | CTGF |
| CTGF-1174-13-13198 | 13198 | NM_001901.2 | connective tissue growth factor | CTGF |
| CTGF-1005-13-13200 | 13200 | NM_001901.2 | connective tissue growth factor | CTGF |
| CTGF-814-13-13202 | 13202 | NM_001901.2 | connective tissue growth factor | CTGF |
| CTGF-816-13-13204 | 13204 | NM_001901.2 | connective tissue growth factor | CTGF |
| CTGF-1001-13-13206 | 13206 | NM_001901.2 | connective tissue growth factor | CTGF |
| CTGF-1173-13-13208 | 13208 | NM_001901.2 | connective tissue growth factor | CTGF |
| CTGF-749-13-13210 | 13210 | NM_001901.2 | connective tissue growth factor | CTGF |
| CTGF-792-13-13212 | 13212 | NM_001901.2 | connective tissue growth factor | CTGF |
| CTGF-1162-13-13214 | 13214 | NM_001901.2 | connective tissue growth factor | CTGF |
| CTGF-811-13-13216 | 13216 | NM_001901.2 | connective tissue growth factor | CTGF |
| CTGF-797-13-13218 | 13218 | NM_001901.2 | connective tissue growth factor | CTGF |
| CTGF-1175-13-13220 | 13220 | NM_001901.2 | connective tissue growth factor | CTGF |
| CTGF-1172-13-13222 | 13222 | NM_001901.2 | connective tissue growth factor | CTGF |
| CTGF-1177-13-13224 | 13224 | NM_001901.2 | connective tissue growth factor | CTGF |
| CTGF-1176-13-13226 | 13226 | NM_001901.2 | connective tissue growth factor | CTGF |
| CTGF-812-13-13228 | 13228 | NM_001901.2 | connective tissue growth factor | CTGF |
| CTGF-745-13-13230 | 13230 | NM_001901.2 | connective tissue growth factor | CTGF |
| CTGF-1230-13-13232 | 13232 | NM_001901.2 | connective tissue growth factor | CTGF |
| CTGF-920-13-13234 | 13234 | NM_001901.2 | connective tissue growth factor | CTGF |
| CTGF-679-13-13236 | 13236 | NM_001901.2 | connective tissue growth factor | CTGF |
| CTGF-992-13-13238 | 13238 | NM_001901.2 | connective tissue growth factor | CTGF |
| CTGF-1045-13-13240 | 13240 | NM_001901.2 | connective tissue growth factor | CTGF |
| CTGF-1231-13-13242 | 13242 | NM_001901.2 | connective tissue growth factor | CTGF |
| CTGF-991-13-13244 | 13244 | NM_001901.2 | connective tissue growth factor | CTGF |
| CTGF-998-13-13246 | 13246 | NM_001901.2 | connective tissue growth factor | CTGF |
| CTGF-1049-13-13248 | 13248 | NM_001901.2 | connective tissue growth factor | CTGF |
| CTGF-1044-13-13250 | 13250 | NM_001901.2 | connective tissue growth factor | CTGF |

TABLE 1-continued

| ID Number | Oligo Number | Accession number | Gene Name | Gene Symbol |
|---|---|---|---|---|
| CTGF-1327-13-13252 | 13252 | NM_001901.2 | connective tissue growth factor | CTGF |
| CTGF-1196-13-13254 | 13254 | NM_001901.2 | connective tissue growth factor | CTGF |
| CTGF-562-13-13256 | 13256 | NM_001901.2 | connective tissue growth factor | CTGF |
| CTGF-752-13-13258 | 13258 | NM_001901.2 | connective tissue growth factor | CTGF |
| CTGF-994-13-13260 | 13260 | NM_001901.2 | connective tissue growth factor | CTGF |
| CTGF-1040-13-13262 | 13262 | NM_001901.2 | connective tissue growth factor | CTGF |
| CTGF-1984-13-13264 | 13264 | NM_001901.2 | connective tissue growth factor | CTGF |
| CTGF-2195-13-13266 | 13266 | NM_001901.2 | connective tissue growth factor | CTGF |
| CTGF-2043-13-13268 | 13268 | NM_001901.2 | connective tissue growth factor | CTGF |
| CTGF-1892-13-13270 | 13270 | NM_001901.2 | connective tissue growth factor | CTGF |
| CTGF-1567-13-13272 | 13272 | NM_001901.2 | connective tissue growth factor | CTGF |
| CTGF-1780-13-13274 | 13274 | NM_001901.2 | connective tissue growth factor | CTGF |
| CTGF-2162-13-13276 | 13276 | NM_001901.2 | connective tissue growth factor | CTGF |
| CTGF-1034-13-13278 | 13278 | NM_001901.2 | connective tissue growth factor | CTGF |
| CTGF-2264-13-13280 | 13280 | NM_001901.2 | connective tissue growth factor | CTGF |
| CTGF-1032-13-13282 | 13282 | NM_001901.2 | connective tissue growth factor | CTGF |
| CTGF-1535-13-13284 | 13284 | NM_001901.2 | connective tissue growth factor | CTGF |
| CTGF-1694-13-13286 | 13286 | NM_001901.2 | connective tissue growth factor | CTGF |
| CTGF-1588-13-13288 | 13288 | NM_001901.2 | connective tissue growth factor | CTGF |
| CTGF-928-13-13290 | 13290 | NM_001901.2 | connective tissue growth factor | CTGF |
| CTGF-1133-13-13292 | 13292 | NM_001901.2 | connective tissue growth factor | CTGF |
| CTGF-912-13-13294 | 13294 | NM_001901.2 | connective tissue growth factor | CTGF |
| CTGF-753-13-13296 | 13296 | NM_001901.2 | connective tissue growth factor | CTGF |
| CTGF-918-13-13298 | 13298 | NM_001901.2 | connective tissue growth factor | CTGF |
| CTGF-744-13-13300 | 13300 | NM_001901.2 | connective tissue growth factor | CTGF |
| CTGF-466-13-13302 | 13302 | NM_001901.2 | connective tissue growth factor | CTGF |
| CTGF-917-13-13304 | 13304 | NM_001901.2 | connective tissue growth factor | CTGF |
| CTGF-1038-13-13306 | 13306 | NM_001901.2 | connective tissue growth factor | CTGF |
| CTGF-1048-13-13308 | 13308 | NM_001901.2 | connective tissue growth factor | CTGF |
| CTGF-1235-13-13310 | 13310 | NM_001901.2 | connective tissue growth factor | CTGF |
| CTGF-868-13-13312 | 13312 | NM_001901.2 | connective tissue growth factor | CTGF |
| CTGF-1131-13-13314 | 13314 | NM_001901.2 | connective tissue growth factor | CTGF |
| CTGF-1043-13-13316 | 13316 | NM_001901.2 | connective tissue growth factor | CTGF |
| CTGF-751-13-13318 | 13318 | NM_001901.2 | connective tissue growth factor | CTGF |
| CTGF-1227-13-13320 | 13320 | NM_001901.2 | connective tissue growth factor | CTGF |
| CTGF-867-13-13322 | 13322 | NM_001901.2 | connective tissue growth factor | CTGF |
| CTGF-1128-13-13324 | 13324 | NM_001901.2 | connective tissue growth factor | CTGF |
| CTGF-756-13-13326 | 13326 | NM_001901.2 | connective tissue growth factor | CTGF |
| CTGF-1234-13-13328 | 13328 | NM_001901.2 | connective tissue growth factor | CTGF |
| CTGF-916-13-13330 | 13330 | NM_001901.2 | connective tissue growth factor | CTGF |
| CTGF-925-13-13332 | 13332 | NM_001901.2 | connective tissue growth factor | CTGF |
| CTGF-1225-13-13334 | 13334 | NM_001901.2 | connective tissue growth factor | CTGF |
| CTGF-445-13-13336 | 13336 | NM_001901.2 | connective tissue growth factor | CTGF |
| CTGF-446-13-13338 | 13338 | NM_001901.2 | connective tissue growth factor | CTGF |
| CTGF-913-13-13340 | 13340 | NM_001901.2 | connective tissue growth factor | CTGF |
| CTGF-997-13-13342 | 13342 | NM_001901.2 | connective tissue growth factor | CTGF |
| CTGF-277-13-13344 | 13344 | NM_001901.2 | connective tissue growth factor | CTGF |
| CTGF-1052-13-13346 | 13346 | NM_001901.2 | connective tissue growth factor | CTGF |
| CTGF-887-13-13348 | 13348 | NM_001901.2 | connective tissue growth factor | CTGF |
| CTGF-914-13-13350 | 13350 | NM_001901.2 | connective tissue growth factor | CTGF |
| CTGF-1039-13-13352 | 13352 | NM_001901.2 | connective tissue growth factor | CTGF |
| CTGF-754-13-13354 | 13354 | NM_001901.2 | connective tissue growth factor | CTGF |
| CTGF-1130-13-13356 | 13356 | NM_001901.2 | connective tissue growth factor | CTGF |
| CTGF-919-13-13358 | 13358 | NM_001901.2 | connective tissue growth factor | CTGF |
| CTGF-922-13-13360 | 13360 | NM_001901.2 | connective tissue growth factor | CTGF |
| CTGF-746-13-13362 | 13362 | NM_001901.2 | connective tissue growth factor | CTGF |
| CTGF-993-13-13364 | 13364 | NM_001901.2 | connective tissue growth factor | CTGF |
| CTGF-825-13-13366 | 13366 | NM_001901.2 | connective tissue growth factor | CTGF |
| CTGF-926-13-13368 | 13368 | NM_001901.2 | connective tissue growth factor | CTGF |
| CTGF-923-13-13370 | 13370 | NM_001901.2 | connective tissue growth factor | CTGF |
| CTGF-866-13-13372 | 13372 | NM_001901.2 | connective tissue growth factor | CTGF |
| CTGF-563-13-13374 | 13374 | NM_001901.2 | connective tissue growth factor | CTGF |
| CTGF-823-13-13376 | 13376 | NM_001901.2 | connective tissue growth factor | CTGF |
| CTGF-1233-13-13378 | 13378 | NM_001901.2 | connective tissue growth factor | CTGF |
| CTGF-924-13-13380 | 13380 | NM_001901.2 | connective tissue growth factor | CTGF |
| CTGF-921-13-13382 | 13382 | NM_001901.2 | connective tissue growth factor | CTGF |
| CTGF-443-13-13384 | 13384 | NM_001901.2 | connective tissue growth factor | CTGF |
| CTGF-1041-13-13386 | 13386 | NM_001901.2 | connective tissue growth factor | CTGF |
| CTGF-1042-13-13388 | 13388 | NM_001901.2 | connective tissue growth factor | CTGF |
| CTGF-755-13-13390 | 13390 | NM_001901.2 | connective tissue growth factor | CTGF |
| CTGF-467-13-13392 | 13392 | NM_001901.2 | connective tissue growth factor | CTGF |
| CTGF-995-13-13394 | 13394 | NM_001901.2 | connective tissue growth factor | CTGF |
| CTGF-927-13-13396 | 13396 | NM_001901.2 | connective tissue growth factor | CTGF |
| SPP1-1025-13-13398 | 13398 | NM_000582.2 | Osteopontin | SPP1 |
| SPP1-1049-13-13400 | 13400 | NM_000582.2 | Osteopontin | SPP1 |
| SPP1-1051-13-13402 | 13402 | NM_000582.2 | Osteopontin | SPP1 |
| SPP1-1048-13-13404 | 13404 | NM_000582.2 | Osteopontin | SPP1 |

TABLE 1-continued

| ID Number | Oligo Number | Accession number | Gene Name | Gene Symbol |
|---|---|---|---|---|
| SPP1-1050-13-13406 | 13406 | NM_000582.2 | Osteopontin | SPP1 |
| SPP1-1047-13-13408 | 13408 | NM_000582.2 | Osteopontin | SPP1 |
| SPP1-800-13-13410 | 13410 | NM_000582.2 | Osteopontin | SPP1 |
| SPP1-492-13-13412 | 13412 | NM_000582.2 | Osteopontin | SPP1 |
| SPP1-612-13-13414 | 13414 | NM_000582.2 | Osteopontin | SPP1 |
| SPP1-481-13-13416 | 13416 | NM_000582.2 | Osteopontin | SPP1 |
| SPP1-614-13-13418 | 13418 | NM_000582.2 | Osteopontin | SPP1 |
| SPP1-951-13-13420 | 13420 | NM_000582.2 | Osteopontin | SPP1 |
| SPP1-482-13-13422 | 13422 | NM_000582.2 | Osteopontin | SPP1 |
| SPP1-856-13-13424 | 13424 | NM_000582.2 | Osteopontin | SPP1 |
| SPP1-857-13-13426 | 13426 | NM_000582.2 | Osteopontin | SPP1 |
| SPP1-365-13-13428 | 13428 | NM_000582.2 | Osteopontin | SPP1 |
| SPP1-359-13-13430 | 13430 | NM_000582.2 | Osteopontin | SPP1 |
| SPP1-357-13-13432 | 13432 | NM_000582.2 | Osteopontin | SPP1 |
| SPP1-858-13-13434 | 13434 | NM_000582.2 | Osteopontin | SPP1 |
| SPP1-1012-13-13436 | 13436 | NM_000582.2 | Osteopontin | SPP1 |
| SPP1-1014-13-13438 | 13438 | NM_000582.2 | Osteopontin | SPP1 |
| SPP1-356-13-13440 | 13440 | NM_000582.2 | Osteopontin | SPP1 |
| SPP1-368-13-13442 | 13442 | NM_000582.2 | Osteopontin | SPP1 |
| SPP1-1011-13-13444 | 13444 | NM_000582.2 | Osteopontin | SPP1 |
| SPP1-754-13-13446 | 13446 | NM_000582.2 | Osteopontin | SPP1 |
| SPP1-1021-13-13448 | 13448 | NM_000582.2 | Osteopontin | SPP1 |
| SPP1-1330-13-13450 | 13450 | NM_000582.2 | Osteopontin | SPP1 |
| SPP1-346-13-13452 | 13452 | NM_000582.2 | Osteopontin | SPP1 |
| SPP1-869-13-13454 | 13454 | NM_000582.2 | Osteopontin | SPP1 |
| SPP1-701-13-13456 | 13456 | NM_000582.2 | Osteopontin | SPP1 |
| SPP1-896-13-13458 | 13458 | NM_000582.2 | Osteopontin | SPP1 |
| SPP1-1035-13-13460 | 13460 | NM_000582.2 | Osteopontin | SPP1 |
| SPP1-1170-13-13462 | 13462 | NM_000582.2 | Osteopontin | SPP1 |
| SPP1-1282-13-13464 | 13464 | NM_000582.2 | Osteopontin | SPP1 |
| SPP1-1537-13-13466 | 13466 | NM_000582.2 | Osteopontin | SPP1 |
| SPP1-692-13-13468 | 13468 | NM_000582.2 | Osteopontin | SPP1 |
| SPP1-840-13-13470 | 13470 | NM_000582.2 | Osteopontin | SPP1 |
| SPP1-1163-13-13472 | 13472 | NM_000582.2 | Osteopontin | SPP1 |
| SPP1-789-13-13474 | 13474 | NM_000582.2 | Osteopontin | SPP1 |
| SPP1-841-13-13476 | 13476 | NM_000582.2 | Osteopontin | SPP1 |
| SPP1-852-13-13478 | 13478 | NM_000582.2 | Osteopontin | SPP1 |
| SPP1-209-13-13480 | 13480 | NM_000582.2 | Osteopontin | SPP1 |
| SPP1-1276-13-13482 | 13482 | NM_000582.2 | Osteopontin | SPP1 |
| SPP1-137-13-13484 | 13484 | NM_000582.2 | Osteopontin | SPP1 |
| SPP1-711-13-13486 | 13486 | NM_000582.2 | Osteopontin | SPP1 |
| SPP1-582-13-13488 | 13488 | NM_000582.2 | Osteopontin | SPP1 |
| SPP1-839-13-13490 | 13490 | NM_000582.2 | Osteopontin | SPP1 |
| SPP1-1091-13-13492 | 13492 | NM_000582.2 | Osteopontin | SPP1 |
| SPP1-884-13-13494 | 13494 | NM_000582.2 | Osteopontin | SPP1 |
| SPP1-903-13-13496 | 13496 | NM_000582.2 | Osteopontin | SPP1 |
| SPP1-1090-13-13498 | 13498 | NM_000582.2 | Osteopontin | SPP1 |
| SPP1-474-13-13500 | 13500 | NM_000582.2 | Osteopontin | SPP1 |
| SPP1-575-13-13502 | 13502 | NM_000582.2 | Osteopontin | SPP1 |
| SPP1-671-13-13504 | 13504 | NM_000582.2 | Osteopontin | SPP1 |
| SPP1-924-13-13506 | 13506 | NM_000582.2 | Osteopontin | SPP1 |
| SPP1-1185-13-13508 | 13508 | NM_000582.2 | Osteopontin | SPP1 |
| SPP1-1221-13-13510 | 13510 | NM_000582.2 | Osteopontin | SPP1 |
| SPP1-347-13-13512 | 13512 | NM_000582.2 | Osteopontin | SPP1 |
| SPP1-634-13-13514 | 13514 | NM_000582.2 | Osteopontin | SPP1 |
| SPP1-877-13-13516 | 13516 | NM_000582.2 | Osteopontin | SPP1 |
| SPP1-1033-13-13518 | 13518 | NM_000582.2 | Osteopontin | SPP1 |
| SPP1-714-13-13520 | 13520 | NM_000582.2 | Osteopontin | SPP1 |
| SPP1-791-13-13522 | 13522 | NM_000582.2 | Osteopontin | SPP1 |
| SPP1-813-13-13524 | 13524 | NM_000582.2 | Osteopontin | SPP1 |
| SPP1-939-13-13526 | 13526 | NM_000582.2 | Osteopontin | SPP1 |
| SPP1-1161-13-13528 | 13528 | NM_000582.2 | Osteopontin | SPP1 |
| SPP1-1164-13-13530 | 13530 | NM_000582.2 | Osteopontin | SPP1 |
| SPP1-1190-13-13532 | 13532 | NM_000582.2 | Osteopontin | SPP1 |
| SPP1-1333-13-13534 | 13534 | NM_000582.2 | Osteopontin | SPP1 |
| SPP1-537-13-13536 | 13536 | NM_000582.2 | Osteopontin | SPP1 |
| SPP1-684-13-13538 | 13538 | NM_000582.2 | Osteopontin | SPP1 |
| SPP1-707-13-13540 | 13540 | NM_000582.2 | Osteopontin | SPP1 |
| SPP1-799-13-13542 | 13542 | NM_000582.2 | Osteopontin | SPP1 |
| SPP1-853-13-13544 | 13544 | NM_000582.2 | Osteopontin | SPP1 |
| SPP1-888-13-13546 | 13546 | NM_000582.2 | Osteopontin | SPP1 |
| SPP1-1194-13-13548 | 13548 | NM_000582.2 | Osteopontin | SPP1 |
| SPP1-1279-13-13550 | 13550 | NM_000582.2 | Osteopontin | SPP1 |
| SPP1-1300-13-13552 | 13552 | NM_000582.2 | Osteopontin | SPP1 |
| SPP1-1510-13-13554 | 13554 | NM_000582.2 | Osteopontin | SPP1 |
| SPP1-1543-13-13556 | 13556 | NM_000582.2 | Osteopontin | SPP1 |
| SPP1-434-13-13558 | 13558 | NM_000582.2 | Osteopontin | SPP1 |

TABLE 1-continued

| ID Number | Oligo Number | Accession number | Gene Name | Gene Symbol |
|---|---|---|---|---|
| SPP1-600-13-13560 | 13560 | NM_000582.2 | Osteopontin | SPP1 |
| SPP1-863-13-13562 | 13562 | NM_000582.2 | Osteopontin | SPP1 |
| SPP1-902-13-13564 | 13564 | NM_000582.2 | Osteopontin | SPP1 |
| SPP1-921-13-13566 | 13566 | NM_000582.2 | Osteopontin | SPP1 |
| SPP1-154-13-13568 | 13568 | NM_000582.2 | Osteopontin | SPP1 |
| SPP1-217-13-13570 | 13570 | NM_000582.2 | Osteopontin | SPP1 |
| SPP1-816-13-13572 | 13572 | NM_000582.2 | Osteopontin | SPP1 |
| SPP1-882-13-13574 | 13574 | NM_000582.2 | Osteopontin | SPP1 |
| SPP1-932-13-13576 | 13576 | NM_000582.2 | Osteopontin | SPP1 |
| SPP1-1509-13-13578 | 13578 | NM_000582.2 | Osteopontin | SPP1 |
| SPP1-157-13-13580 | 13580 | NM_000582.2 | Osteopontin | SPP1 |
| SPP1-350-13-13582 | 13582 | NM_000582.2 | Osteopontin | SPP1 |
| SPP1-511-13-13584 | 13584 | NM_000582.2 | Osteopontin | SPP1 |
| SPP1-605-13-13586 | 13586 | NM_000582.2 | Osteopontin | SPP1 |
| SPP1-811-13-13588 | 13588 | NM_000582.2 | Osteopontin | SPP1 |
| SPP1-892-13-13590 | 13590 | NM_000582.2 | Osteopontin | SPP1 |
| SPP1-922-13-13592 | 13592 | NM_000582.2 | Osteopontin | SPP1 |
| SPP1-1169-13-13594 | 13594 | NM_000582.2 | Osteopontin | SPP1 |
| SPP1-1182-13-13596 | 13596 | NM_000582.2 | Osteopontin | SPP1 |
| SPP1-1539-13-13598 | 13598 | NM_000582.2 | Osteopontin | SPP1 |
| SPP1-1541-13-13600 | 13600 | NM_000582.2 | Osteopontin | SPP1 |
| SPP1-427-13-13602 | 13602 | NM_000582.2 | Osteopontin | SPP1 |
| SPP1-533-13-13604 | 13604 | NM_000582.2 | Osteopontin | SPP1 |
| APOB--13-13763 | 13763 | NM_000384 | Apolipoprotein B (including Ag(x) antigen) | APOB |
| APOB--13-13764 | 13764 | NM_000384 | Apolipoprotein B (including Ag(x) antigen) | APOB |
| MAP4K4--16-13766 | 13766 | | | MAP4K4 |
| PPIB--13-13767 | 13767 | NM_000942 | peptidylprolyl isomerase B (cyclophilin B) | PPIB |
| PPIB--15-13768 | 13768 | NM_000942 | peptidylprolyl isomerase B (cyclophilin B) | PPIB |
| PPIB--17-13769 | 13769 | NM_000942 | peptidylprolyl isomerase B (cyclophilin B) | PPIB |
| MAP4K4--16-13939 | 13939 | | | MAP4K4 |
| APOB-4314-16-13940 | 13940 | NM_000384 | Apolipoprotein B (including Ag(x) antigen) | APOB |
| APOB-4314-17-13941 | 13941 | NM_000384 | Apolipoprotein B (including Ag(x) antigen) | APOB |
| APOB--16-13942 | 13942 | NM_000384 | Apolipoprotein B (including Ag(x) antigen) | APOB |
| APOB--18-13943 | 13943 | NM_000384 | Apolipoprotein B (including Ag(x) antigen) | APOB |
| APOB--17-13944 | 13944 | NM_000384 | Apolipoprotein B (including Ag(x) antigen) | APOB |
| APOB--19-13945 | 13945 | NM_000384 | Apolipoprotein B (including Ag(x) antigen) | APOB |
| APOB-4314-16-13946 | 13946 | NM_000384 | Apolipoprotein B (including Ag(x) antigen) | APOB |
| APOB-4314-17-13947 | 13947 | NM_000384 | Apolipoprotein B (including Ag(x) antigen) | APOB |
| APOB--16-13948 | 13948 | NM_000384 | Apolipoprotein B (including Ag(x) antigen) | APOB |
| APOB--17-13949 | 13949 | NM_000384 | Apolipoprotein B (including Ag(x) antigen) | APOB |
| APOB--16-13950 | 13950 | NM_000384 | Apolipoprotein B (including Ag(x) antigen) | APOB |
| APOB--18-13951 | 13951 | NM_000384 | Apolipoprotein B (including Ag(x) antigen) | APOB |
| APOB--17-13952 | 13952 | NM_000384 | Apolipoprotein B (including Ag(x) antigen) | APOB |
| APOB--19-13953 | 13953 | NM_000384 | Apolipoprotein B (including Ag(x) antigen) | APOB |
| MAP4K4--16-13766.2 | 13766.2 | | | MAP4K4 |
| CTGF-1222-16-13980 | 13980 | NM_001901.2 | connective tissue growth factor | CTGF |
| CTGF-813-16-13981 | 13981 | NM_001901.2 | connective tissue growth factor | CTGF |
| CTGF-747-16-13982 | 13982 | NM_001901.2 | connective tissue growth factor | CTGF |
| CTGF-817-16-13983 | 13983 | NM_001901.2 | connective tissue growth factor | CTGF |
| CTGF-1174-16-13984 | 13984 | NM_001901.2 | connective tissue growth factor | CTGF |
| CTGF-1005-16-13985 | 13985 | NM_001901.2 | connective tissue growth factor | CTGF |
| CTGF-814-16-13986 | 13986 | NM_001901.2 | connective tissue growth factor | CTGF |
| CTGF-816-16-13987 | 13987 | NM_001901.2 | connective tissue growth factor | CTGF |
| CTGF-1001-16-13988 | 13988 | NM_001901.2 | connective tissue growth factor | CTGF |
| CTGF-1173-16-13989 | 13989 | NM_001901.2 | connective tissue growth factor | CTGF |
| CTGF-749-16-13990 | 13990 | NM_001901.2 | connective tissue growth factor | CTGF |
| CTGF-792-16-13991 | 13991 | NM_001901.2 | connective tissue growth factor | CTGF |
| CTGF-1162-16-13992 | 13992 | NM_001901.2 | connective tissue growth factor | CTGF |

TABLE 1-continued

| ID Number | Oligo Number | Accession number | Gene Name | Gene Symbol |
|---|---|---|---|---|
| CTGF-811-16-13993 | 13993 | NM_001901.2 | connective tissue growth factor | CTGF |
| CTGF-797-16-13994 | 13994 | NM_001901.2 | connective tissue growth factor | CTGF |
| CTGF-1175-16-13995 | 13995 | NM_001901.2 | connective tissue growth factor | CTGF |
| CTGF-1172-16-13996 | 13996 | NM_001901.2 | connective tissue growth factor | CTGF |
| CTGF-1177-16-13997 | 13997 | NM_001901.2 | connective tissue growth factor | CTGF |
| CTGF-1176-16-13998 | 13998 | NM_001901.2 | connective tissue growth factor | CTGF |
| CTGF-812-16-13999 | 13999 | NM_001901.2 | connective tissue growth factor | CTGF |
| CTGF-745-16-14000 | 14000 | NM_001901.2 | connective tissue growth factor | CTGF |
| CTGF-1230-16-14001 | 14001 | NM_001901.2 | connective tissue growth factor | CTGF |
| CTGF-920-16-14002 | 14002 | NM_001901.2 | connective tissue growth factor | CTGF |
| CTGF-679-16-14003 | 14003 | NM_001901.2 | connective tissue growth factor | CTGF |
| CTGF-992-16-14004 | 14004 | NM_001901.2 | connective tissue growth factor | CTGF |
| CTGF-1045-16-14005 | 14005 | NM_001901.2 | connective tissue growth factor | CTGF |
| CTGF-1231-16-14006 | 14006 | NM_001901.2 | connective tissue growth factor | CTGF |
| CTGF-991-16-14007 | 14007 | NM_001901.2 | connective tissue growth factor | CTGF |
| CTGF-998-16-14008 | 14008 | NM_001901.2 | connective tissue growth factor | CTGF |
| CTGF-1049-16-14009 | 14009 | NM_001901.2 | connective tissue growth factor | CTGF |
| CTGF-1044-16-14010 | 14010 | NM_001901.2 | connective tissue growth factor | CTGF |
| CTGF-1327-16-14011 | 14011 | NM_001901.2 | connective tissue growth factor | CTGF |
| CTGF-1196-16-14012 | 14012 | NM_001901.2 | connective tissue growth factor | CTGF |
| CTGF-562-16-14013 | 14013 | NM_001901.2 | connective tissue growth factor | CTGF |
| CTGF-752-16-14014 | 14014 | NM_001901.2 | connective tissue growth factor | CTGF |
| CTGF-994-16-14015 | 14015 | NM_001901.2 | connective tissue growth factor | CTGF |
| CTGF-1040-16-14016 | 14016 | NM_001901.2 | connective tissue growth factor | CTGF |
| CTGF-1984-16-14017 | 14017 | NM_001901.2 | connective tissue growth factor | CTGF |
| CTGF-2195-16-14018 | 14018 | NM_001901.2 | connective tissue growth factor | CTGF |
| CTGF-2043-16-14019 | 14019 | NM_001901.2 | connective tissue growth factor | CTGF |
| CTGF-1892-16-14020 | 14020 | NM_001901.2 | connective tissue growth factor | CTGF |
| CTGF-1567-16-14021 | 14021 | NM_001901.2 | connective tissue growth factor | CTGF |
| CTGF-1780-16-14022 | 14022 | NM_001901.2 | connective tissue growth factor | CTGF |
| CTGF-2162-16-14023 | 14023 | NM_001901.2 | connective tissue growth factor | CTGF |
| CTGF-1034-16-14024 | 14024 | NM_001901.2 | connective tissue growth factor | CTGF |
| CTGF-2264-16-14025 | 14025 | NM_001901.2 | connective tissue growth factor | CTGF |
| CTGF-1032-16-14026 | 14026 | NM_001901.2 | connective tissue growth factor | CTGF |
| CTGF-1535-16-14027 | 14027 | NM_001901.2 | connective tissue growth factor | CTGF |
| CTGF-1694-16-14028 | 14028 | NM_001901.2 | connective tissue growth factor | CTGF |
| CTGF-1588-16-14029 | 14029 | NM_001901.2 | connective tissue growth factor | CTGF |
| CTGF-928-16-14030 | 14030 | NM_001901.2 | connective tissue growth factor | CTGF |
| CTGF-1133-16-14031 | 14031 | NM_001901.2 | connective tissue growth factor | CTGF |
| CTGF-912-16-14032 | 14032 | NM_001901.2 | connective tissue growth factor | CTGF |
| CTGF-753-16-14033 | 14033 | NM_001901.2 | connective tissue growth factor | CTGF |
| CTGF-918-16-14034 | 14034 | NM_001901.2 | connective tissue growth factor | CTGF |
| CTGF-744-16-14035 | 14035 | NM_001901.2 | connective tissue growth factor | CTGF |
| CTGF-466-16-14036 | 14036 | NM_001901.2 | connective tissue growth factor | CTGF |
| CTGF-917-16-14037 | 14037 | NM_001901.2 | connective tissue growth factor | CTGF |
| CTGF-1038-16-14038 | 14038 | NM_001901.2 | connective tissue growth factor | CTGF |
| CTGF-1048-16-14039 | 14039 | NM_001901.2 | connective tissue growth factor | CTGF |
| CTGF-1235-16-14040 | 14040 | NM_001901.2 | connective tissue growth factor | CTGF |
| CTGF-868-16-14041 | 14041 | NM_001901.2 | connective tissue growth factor | CTGF |
| CTGF-1131-16-14042 | 14042 | NM_001901.2 | connective tissue growth factor | CTGF |
| CTGF-1043-16-14043 | 14043 | NM_001901.2 | connective tissue growth factor | CTGF |
| CTGF-751-16-14044 | 14044 | NM_001901.2 | connective tissue growth factor | CTGF |
| CTGF-1227-16-14045 | 14045 | NM_001901.2 | connective tissue growth factor | CTGF |
| CTGF-867-16-14046 | 14046 | NM_001901.2 | connective tissue growth factor | CTGF |
| CTGF-1128-16-14047 | 14047 | NM_001901.2 | connective tissue growth factor | CTGF |
| CTGF-756-16-14048 | 14048 | NM_001901.2 | connective tissue growth factor | CTGF |
| CTGF-1234-16-14049 | 14049 | NM_001901.2 | connective tissue growth factor | CTGF |
| CTGF-916-16-14050 | 14050 | NM_001901.2 | connective tissue growth factor | CTGF |
| CTGF-925-16-14051 | 14051 | NM_001901.2 | connective tissue growth factor | CTGF |
| CTGF-1225-16-14052 | 14052 | NM_001901.2 | connective tissue growth factor | CTGF |
| CTGF-445-16-14053 | 14053 | NM_001901.2 | connective tissue growth factor | CTGF |
| CTGF-446-16-14054 | 14054 | NM_001901.2 | connective tissue growth factor | CTGF |
| CTGF-913-16-14055 | 14055 | NM_001901.2 | connective tissue growth factor | CTGF |
| CTGF-997-16-14056 | 14056 | NM_001901.2 | connective tissue growth factor | CTGF |
| CTGF-277-16-14057 | 14057 | NM_001901.2 | connective tissue growth factor | CTGF |
| CTGF-1052-16-14058 | 14058 | NM_001901.2 | connective tissue growth factor | CTGF |
| CTGF-887-16-14059 | 14059 | NM_001901.2 | connective tissue growth factor | CTGF |
| CTGF-914-16-14060 | 14060 | NM_001901.2 | connective tissue growth factor | CTGF |
| CTGF-1039-16-14061 | 14061 | NM_001901.2 | connective tissue growth factor | CTGF |
| CTGF-754-16-14062 | 14062 | NM_001901.2 | connective tissue growth factor | CTGF |
| CTGF-1130-16-14063 | 14063 | NM_001901.2 | connective tissue growth factor | CTGF |
| CTGF-919-16-14064 | 14064 | NM_001901.2 | connective tissue growth factor | CTGF |
| CTGF-922-16-14065 | 14065 | NM_001901.2 | connective tissue growth factor | CTGF |
| CTGF-746-16-14066 | 14066 | NM_001901.2 | connective tissue growth factor | CTGF |
| CTGF-993-16-14067 | 14067 | NM_001901.2 | connective tissue growth factor | CTGF |
| CTGF-825-16-14068 | 14068 | NM_001901.2 | connective tissue growth factor | CTGF |
| CTGF-926-16-14069 | 14069 | NM_001901.2 | connective tissue growth factor | CTGF |

TABLE 1-continued

| ID Number | Oligo Number | Accession number | Gene Name | Gene Symbol |
|---|---|---|---|---|
| CTGF-923-16-14070 | 14070 | NM_001901.2 | connective tissue growth factor | CTGF |
| CTGF-866-16-14071 | 14071 | NM_001901.2 | connective tissue growth factor | CTGF |
| CTGF-563-16-14072 | 14072 | NM_001901.2 | connective tissue growth factor | CTGF |
| CTGF-823-16-14073 | 14073 | NM_001901.2 | connective tissue growth factor | CTGF |
| CTGF-1233-16-14074 | 14074 | NM_001901.2 | connective tissue growth factor | CTGF |
| CTGF-924-16-14075 | 14075 | NM_001901.2 | connective tissue growth factor | CTGF |
| CTGF-921-16-14076 | 14076 | NM_001901.2 | connective tissue growth factor | CTGF |
| CTGF-443-16-14077 | 14077 | NM_001901.2 | connective tissue growth factor | CTGF |
| CTGF-1041-16-14078 | 14078 | NM_001901.2 | connective tissue growth factor | CTGF |
| CTGF-1042-16-14079 | 14079 | NM_001901.2 | connective tissue growth factor | CTGF |
| CTGF-755-16-14080 | 14080 | NM_001901.2 | connective tissue growth factor | CTGF |
| CTGF-467-16-14081 | 14081 | NM_001901.2 | connective tissue growth factor | CTGF |
| CTGF-995-16-14082 | 14082 | NM_001901.2 | connective tissue growth factor | CTGF |
| CTGF-927-16-14083 | 14083 | NM_001901.2 | connective tissue growth factor | CTGF |
| SPP1-1091-16-14131 | 14131 | NM_000582.2 | Osteopontin | SPP1 |
| PPIB--16-14188 | 14188 | NM_000942 | peptidylprolyl isomerase B (cyclophilin B) | PPIB |
| PPIB--17-14189 | 14189 | NM_000942 | peptidylprolyl isomerase B (cyclophilin B) | PPIB |
| PPIB--18-14190 | 14190 | NM_000942 | peptidylprolyl isomerase B (cyclophilin B) | PPIB |
| pGL3-1172-16-14386 | 14386 | U47296 | Cloning vector pGL3-Control | pGL3 |
| pGL3-1172-16-14387 | 14387 | U47296 | Cloning vector pGL3-Control | pGL3 |
| MAP4K4-2931-25-14390 | 14390 | NM_004834 | Mitogen-Activated Protein Kinase Kinase Kinase Kinase 4 (MAP4K4), transcript variant 1 | MAP4K4 |
| miR-122--23-14391 | 14391 | | | miR-122 |
| | 14084 | NM_000582.2 | Osteopontin | SPP1 |
| | 14085 | NM_000582.2 | Osteopontin | SPP1 |
| | 14086 | NM_000582.2 | Osteopontin | SPP1 |
| | 14087 | NM_000582.2 | Osteopontin | SPP1 |
| | 14088 | NM_000582.2 | Osteopontin | SPP1 |
| | 14089 | NM_000582.2 | Osteopontin | SPP1 |
| | 14090 | NM_000582.2 | Osteopontin | SPP1 |
| | 14091 | NM_000582.2 | Osteopontin | SPP1 |
| | 14092 | NM_000582.2 | Osteopontin | SPP1 |
| | 14093 | NM_000582.2 | Osteopontin | SPP1 |
| | 14094 | NM_000582.2 | Osteopontin | SPP1 |
| | 14095 | NM_000582.2 | Osteopontin | SPP1 |
| | 14096 | NM_000582.2 | Osteopontin | SPP1 |
| | 14097 | NM_000582.2 | Osteopontin | SPP1 |
| | 14098 | NM_000582.2 | Osteopontin | SPP1 |
| | 14099 | NM_000582.2 | Osteopontin | SPP1 |
| | 14100 | NM_000582.2 | Osteopontin | SPP1 |
| | 14101 | NM_000582.2 | Osteopontin | SPP1 |
| | 14102 | NM_000582.2 | Osteopontin | SPP1 |
| | 14103 | NM_000582.2 | Osteopontin | SPP1 |
| | 14104 | NM_000582.2 | Osteopontin | SPP1 |
| | 14105 | NM_000582.2 | Osteopontin | SPP1 |
| | 14106 | NM_000582.2 | Osteopontin | SPP1 |
| | 14107 | NM_000582.2 | Osteopontin | SPP1 |
| | 14108 | NM_000582.2 | Osteopontin | SPP1 |
| | 14109 | NM_000582.2 | Osteopontin | SPP1 |
| | 14110 | NM_000582.2 | Osteopontin | SPP1 |
| | 14111 | NM_000582.2 | Osteopontin | SPP1 |
| | 14112 | NM_000582.2 | Osteopontin | SPP1 |
| | 14113 | NM_000582.2 | Osteopontin | SPP1 |
| | 14114 | NM_000582.2 | Osteopontin | SPP1 |
| | 14115 | NM_000582.2 | Osteopontin | SPP1 |
| | 14116 | NM_000582.2 | Osteopontin | SPP1 |
| | 14117 | NM_000582.2 | Osteopontin | SPP1 |
| | 14118 | NM_000582.2 | Osteopontin | SPP1 |
| | 14119 | NM_000582.2 | Osteopontin | SPP1 |
| | 14120 | NM_000582.2 | Osteopontin | SPP1 |
| | 14121 | NM_000582.2 | Osteopontin | SPP1 |
| | 14122 | NM_000582.2 | Osteopontin | SPP1 |
| | 14123 | NM_000582.2 | Osteopontin | SPP1 |
| | 14124 | NM_000582.2 | Osteopontin | SPP1 |
| | 14125 | NM_000582.2 | Osteopontin | SPP1 |
| | 14126 | NM_000582.2 | Osteopontin | SPP1 |
| | 14127 | NM_000582.2 | Osteopontin | SPP1 |
| | 14128 | NM_000582.2 | Osteopontin | SPP1 |
| | 14129 | NM_000582.2 | Osteopontin | SPP1 |
| | 14130 | NM_000582.2 | Osteopontin | SPP1 |
| | 14132 | NM_000582.2 | Osteopontin | SPP1 |
| | 14133 | NM_000582.2 | Osteopontin | SPP1 |
| | 14134 | NM_000582.2 | Osteopontin | SPP1 |

TABLE 1-continued

| ID Number | Oligo Number | Accession number | Gene Name | Gene Symbol |
|---|---|---|---|---|
| | 14135 | NM_000582.2 | Osteopontin | SPP1 |
| | 14136 | NM_000582.2 | Osteopontin | SPP1 |
| | 14137 | NM_000582.2 | Osteopontin | SPP1 |
| | 14138 | NM_000582.2 | Osteopontin | SPP1 |
| | 14139 | NM_000582.2 | Osteopontin | SPP1 |
| | 14140 | NM_000582.2 | Osteopontin | SPP1 |
| | 14141 | NM_000582.2 | Osteopontin | SPP1 |
| | 14142 | NM_000582.2 | Osteopontin | SPP1 |
| | 14143 | NM_000582.2 | Osteopontin | SPP1 |
| | 14144 | NM_000582.2 | Osteopontin | SPP1 |
| | 14145 | NM_000582.2 | Osteopontin | SPP1 |
| | 14146 | NM_000582.2 | Osteopontin | SPP1 |
| | 14147 | NM_000582.2 | Osteopontin | SPP1 |
| | 14148 | NM_000582.2 | Osteopontin | SPP1 |
| | 14149 | NM_000582.2 | Osteopontin | SPP1 |
| | 14150 | NM_000582.2 | Osteopontin | SPP1 |
| | 14151 | NM_000582.2 | Osteopontin | SPP1 |
| | 14152 | NM_000582.2 | Osteopontin | SPP1 |
| | 14153 | NM_000582.2 | Osteopontin | SPP1 |
| | 14154 | NM_000582.2 | Osteopontin | SPP1 |
| | 14155 | NM_000582.2 | Osteopontin | SPP1 |
| | 14156 | NM_000582.2 | Osteopontin | SPP1 |
| | 14157 | NM_000582.2 | Osteopontin | SPP1 |
| | 14158 | NM_000582.2 | Osteopontin | SPP1 |
| | 14159 | NM_000582.2 | Osteopontin | SPP1 |
| | 14160 | NM_000582.2 | Osteopontin | SPP1 |
| | 14161 | NM_000582.2 | Osteopontin | SPP1 |
| | 14162 | NM_000582.2 | Osteopontin | SPP1 |
| | 14163 | NM_000582.2 | Osteopontin | SPP1 |
| | 14164 | NM_000582.2 | Osteopontin | SPP1 |
| | 14165 | NM_000582.2 | Osteopontin | SPP1 |
| | 14166 | NM_000582.2 | Osteopontin | SPP1 |
| | 14167 | NM_000582.2 | Osteopontin | SPP1 |
| | 14168 | NM_000582.2 | Osteopontin | SPP1 |
| | 14169 | NM_000582.2 | Osteopontin | SPP1 |
| | 14170 | NM_000582.2 | Osteopontin | SPP1 |
| | 14171 | NM_000582.2 | Osteopontin | SPP1 |
| | 14172 | NM_000582.2 | Osteopontin | SPP1 |
| | 14173 | NM_000582.2 | Osteopontin | SPP1 |
| | 14174 | NM_000582.2 | Osteopontin | SPP1 |
| | 14175 | NM_000582.2 | Osteopontin | SPP1 |
| | 14176 | NM_000582.2 | Osteopontin | SPP1 |
| | 14177 | NM_000582.2 | Osteopontin | SPP1 |
| | 14178 | NM_000582.2 | Osteopontin | SPP1 |
| | 14179 | NM_000582.2 | Osteopontin | SPP1 |
| | 14180 | NM_000582.2 | Osteopontin | SPP1 |
| | 14181 | NM_000582.2 | Osteopontin | SPP1 |
| | 14182 | NM_000582.2 | Osteopontin | SPP1 |
| | 14183 | NM_000582.2 | Osteopontin | SPP1 |
| | 14184 | NM_000582.2 | Osteopontin | SPP1 |
| | 14185 | NM_000582.2 | Osteopontin | SPP1 |
| | 14186 | NM_000582.2 | Osteopontin | SPP1 |
| | 14187 | NM_000582.2 | Osteopontin | SPP1 |

TABLE 2

| ID Number | Oligo # | AntiSense Backbone | AntiSense Chemistry | AntiSense Sequence | SEQ ID NO: |
|---|---|---|---|---|---|
| APOB-10167-20-12138 | 12138 | oooooooooooooooooo | 000000000000000000m | AUUGGUAUUCAGUGUGAUG | 1 |
| APOB-10167-20-12139 | 12139 | oooooooooooooooooo | 000000000000000000m | AUUCGUAUUGAGUCUGAUC | 2 |
| MAP4K4-2931-16-12293 | 12293 | oooooooooooooooo | Pf000fffff0f0000fff0 | UAGACUUCCACAGAACUCU | 3 |
| MAP4K4-2931-16-12383 | 12383 | oooooooooooooooo | 0000000000000000 | UAGACUUCCACAGAACUCU | 4 |
| MAP4K4-2931-16-12384 | 12384 | oooooooooooooooo | P000000000000000000 | UAGACUUCCACAGAACUCU | 5 |
| MAP4K4-2931-16-12385 | 12385 | oooooooooooooooo | Pf000fffff0f0000fff0 | UAGACUUCCACAGAACUCU | 6 |
| MAP4K4-2931-16-12386 | 12386 | ooooooooooossssssso | Pf000fffff0f0000fff0 | UAGACUUCCACAGAACUCU | 7 |

TABLE 2-continued

| ID Number | Oligo # | AntiSense Backbone | AntiSense Chemistry | AntiSense Sequence | SEQ ID NO: |
|---|---|---|---|---|---|
| MAP4K4-2931-16-12387 | 12387 | ooooooooooossssssso | P0000000000000000000 | UAGACUUCCACAGAACUCU | 8 |
| MAP4K4-2931-15-12388 | 12388 | oooooooooooooooo | 000000000000000 | UAGACUUCCACAGAACU | 9 |
| APOB-21-12434 | 12434 | ooooooooooooooooooo | 00000000000000000m | AUUGGUAUUCAGUGUGAUGAC | 10 |
| APOB-21-12435 | 12435 | ooooooooooooooooooo | 00000000000000000m | AUUCGUAUUGAGUCUGAUCAC | 11 |
| MAP4K4-2931-16-12451 | 12451 | ooooooooooossssssso | Pf000fffff0f0000ffmm | UAGACUUCCACAGAACUCU | 12 |
| MAP4K4-2931-16-12452 | 12452 | ooooooooooossssssso | Pm000fffff0f0000ffmm | UAGACUUCCACAGAACUCU | 13 |
| MAP4K4-2931-16-12453 | 12453 | ooooossssssssssso | Pm000fffff0f0000ffmm | UAGACUUCCACAGAACUCU | 14 |
| MAP4K4-2931-17-12454 | 12454 | ooooooooooosssssssso | Pm000fffff0f0000ffffmm | UAGACUUCCACAGAACUCUUC | 15 |
| MAP4K4-2931-17-12455 | 12455 | ooooossssssssssssso | Pm000fffff0f0000ffffmm | UAGACUUCCACAGAACUCUUC | 16 |
| MAP4K4-2931-19-12456 | 12456 | ooooooooooossssssssssso | Pm000fffff0f0000fffffff00mm | UAGACUUCCACAGAACUCUUCAAAG | 17 |
| apob-10167-21-12505 | 12505 | ooooooooooooooooooos | 00000000000000000m | AUUGGUAUUCAGUGUGAUGAC | 18 |
| APOB-10167-21-12506 | 12506 | ooooooooooooooooooos | 00000000000000000m | AUUCGUAUUGAGUCUGAUCAC | 19 |
| MAP4K4-2931-16-12539 | 12539 | ooooooooooossssssss | Pf000fffff0f0000fff0 | UAGACUUCCACAGAACUCU | 20 |
| APOB-10167-21-12505.2 | 12505.2 | ooooooooooooooooooo | 00000000000000000m | AUUGGUAUUCAGUGUGAUGAC | 21 |
| APOB-10167-21-12506.2 | 12506.2 | ooooooooooooooooooo | 00000000000000000m | AUUCGUAUUGAGUCUGAUCAC | 22 |
| MAP4K4-2931-16-12386.2 | 12386.2 | ooooooooooossssssso | Pf000fffff0f0000fff0 | UAGACUUCCACAGAACUCU | 23 |
| MAP4K4--16-12983 | 12983 | ooooooooooossssssso | Pm000fffff0m0000mmm0 | uagacuuccacagaacucu | 24 |
| MAP4K4--16-12984 | 12984 | ooooooooooosssssss | Pm000fffff0m0000mmm0 | uagacuuccacagaacucu | 25 |
| MAP4K4--16-12985 | 12985 | ooooooooooossssssso | Pm000fffff0m0000mmm0 | uagacuuccacagaacucu | 26 |
| MAP4K4--16-12986 | 12986 | ooooooooooossssssso | Pf000fffff0f0000fff0 | UAGACUUCCACAGAACUCU | 27 |
| MAP4K4--16-12987 | 12987 | ooooooooooossssssss | P0000f00ff0m0000m0m0 | UagacUUccacagaacUcU | 28 |
| MAP4K4--16-12988 | 12988 | ooooooooooossssssss | P0000f00ff0m0000m0m0 | UagacUUccacagaacUcu | 29 |
| MAP4K4--16-12989 | 12989 | ooooooooooossssssss | P0000ff0ff0m0000m0m0 | UagacuUccacagaacUcu | 30 |
| MAP4K4--16-12990 | 12990 | ooooooooooossssssss | Pf0000ff000000000m00 | uagaCuuCCaCagaaCuCu | 31 |
| MAP4K4--16-12991 | 12991 | ooooooooooossssssss | Pf0000fff00m0000mm0 | uagaCuuCCacagaaCucu | 32 |
| MAP4K4--16-12992 | 12992 | ooooooooooossssssss | Pf000fffff0000000m00 | uagacuuccaCagaaCuCu | 33 |
| MAP4K4--16-12993 | 12993 | ooooooooooossssssss | P0000000000000000000 | UagaCUUCCaCagaaCUCU | 34 |
| MAP4K4--16-12994 | 12994 | ooooooooooossssssss | P0000f0f0f0000000m00 | UagacUcCcaCagaaCuCu | 35 |
| MAP4K4--16-12995 | 12995 | ooooooooooossssssso | Pf000fffff0000000000 | uagacuuccaCagaaCUCU | 36 |
| --16-13047 | 13047 | ooooooooooossssssss | Pm000000000m0000mmm0 | UAGACUUCCACAGAACUCU | 37 |
| PPIB--16-13136 | 13136 | ooooooooooossssssss | Pm0fffff0f00mm000mm0 | UGUUUUGUAGCCAAAUCC | 38 |
| SOD1-530-16-13163 | 13163 | ooooooooooossssssso | Pm0fffffff0mmmmm0m0 | UACUUUCUUCAUUCCACC | 39 |
| SOD1-523-16-13164 | 13164 | ooooooooooossssssso | Pmff0fffff0fmmmm0mm0 | UUCAUUCCACCUUUGCCC | 40 |
| SOD1-535-16-13165 | 13165 | ooooooooooossssssso | Pmfff0f0ffffmmmm0mm0 | CUUUGUACUUUCUUCAUUU | 41 |

TABLE 2-continued

| ID Number | Oligo # | AntiSense Backbone | AntiSense Chemistry | AntiSense Sequence | SEQ ID NO: |
|---|---|---|---|---|---|
| SOD1-536-16-13166 | 13166 | ooooooooooooossssso | Pmffff0f0fffmmmmm0m0 | UCUUUGUACUUUCUUCAUU | 42 |
| SOD1-396-16-13167 | 13167 | ooooooooooooossssso | Pmf00f00ff0f0mmmmm0 | UCAGCAGUCACAUUGCCCA | 43 |
| SOD1-385-16-13168 | 13168 | ooooooooooooossssso | Pmff0fff000fmmmm00m0 | AUUGCCCAAGUCUCCAACA | 44 |
| SOD1-195-16-13169 | 13169 | ooooooooooooossssso | Pmfff0fff0000mm00m00 | UUCUGCUCGAAAUUGAUGA | 45 |
| pGL3-1172-16-13170 | 13170 | ooooooooooooossssso | Pm00ff0f0ffm0ff00mm0 | AAAUCGUAUUUGUCAAUCA | 46 |
| pGL3-1172-16-13171 | 13171 | oooooooooooooosssss | Pm00ff0f0ffm0ff00mm0 | AAAUCGUAUUUGUCAAUCA | 47 |
| MAP4k4-2931-19-13189 | 13189 | oooooooooooooooooo | 0000000000000000000 | UAGACUUCCACAGAACUCU | 48 |
| MAP4K4--16-13766 | 13766 | ooooooooooooossssso | Pm000fffff0m0000mmm0 | UAGACUUCCACAGAACUCU | 49 |
| MAP4K4--16-13939 | 13939 | ooooooooooooossssso | m000f0ffff0m0m00m0m | UAGACAUCCUACACAGCAC | 50 |
| APOB-4314-16-13940 | 13940 | ooooooooooooossssso | Pm0fffffff000mmmmm0 | UGUUUCUCCAGAUCCUUGC | 51 |
| APOB-4314-17-13941 | 13941 | ooooooooooooossssso | Pm0fffffff000mmmmm00 | UGUUUCUCCAGAUCCUUGC | 52 |
| APOB-16-13942 | 13942 | ooooooooooooossssso | Pm00f000f000mmm0mmm0 | UAGCAGAUGAGUCCAUUUG | 53 |
| APOB--18-13943 | 13943 | oooooooooooooooosssssso | Pm00f000f000mmm0mmm0 0000 | UAGCAGAUGAGUCCAUUUG GAGA | 54 |
| APOB--17-13944 | 13944 | ooooooooooooossssso | Pm00f000f000mmm0mmm0 | UAGCAGAUGAGUCCAUUUG | 55 |
| APOB--19-13945 | 13945 | oooooooooooooooosssssso | Pm00f000f000mmm0mmm0 0000 | UAGCAGAUGAGUCCAUUUG GAGA | 56 |
| APOB-4314-16-13946 | 13946 | ooooooooooooossssso | Pmf0ff0ffffmmm000mm0 | AUGUUGUUUCUCCAGAUCC | 57 |
| APOB-4314-17-13947 | 13947 | ooooooooooooossssso | Pmf0ff0ffffmmm000mm0 | AUGUUGUUUCUCCAGAUCC | 58 |
| APOB--16-13948 | 13948 | ooooooooooooossssso | Pm0fff000000mmmm00m0 | UGUUUGAGGGACUCUGUGA | 59 |
| APOB--17-13949 | 13949 | ooooooooooooossssso | Pm0fff000000mmmm00m0 | UGUUUGAGGGACUCUGUGA | 60 |
| APOB--16-13950 | 13950 | ooooooooooooossssso | Pmff00f0fff00m0m00m0 | AUUGGUAUUCAGUGUGAUG | 61 |
| APOB--18-13951 | 13951 | oooooooooooooooosssssso | Pmff00f0fff00m0m00m0 0m00 | AUUGGUAUUCAGUGUGAUG ACAC | 62 |
| APOB--17-13952 | 13952 | ooooooooooooossssso | Pmff00f0fff00m0m00m0 | AUUGGUAUUCAGUGUGAUG | 63 |
| APOB--19-13953 | 13953 | oooooooooooooooosssssso | Pmff00f0fff00m0m00m0 0m00 | AUUGGUAUUCAGUGUGAUG ACAC | 64 |
| MAP4K4--16-13766.2 | 13766.2 | ooooooooooooossssso | Pm000fffff0m0000mmm0 | UAGACUUCCACAGAACUCU | 65 |
| CTGF-1222-16-13980 | 13980 | ooooooooooooossssso | Pm0f0fffffffm0m00m0m0 | UACAUCUUCCUGUAGUACA | 66 |
| CTGF-813-16-13981 | 13981 | ooooooooooooossssso | Pm0f0ffff0mmmm0m000 | AGGCGCUCCACUCUGUGGU | 67 |
| CTGF-747-16-13982 | 13982 | ooooooooooooossssso | Pm0fffffff00mm0m0000 | UGUCUUCCAGUCGGUAAGC | 68 |
| CTGF-817-16-13983 | 13983 | ooooooooooooossssso | Pm00f000f0fmmm0mmmm0 | GAACAGGCGCUCCACUCUG | 69 |
| CTGF-1174-16-13984 | 13984 | ooooooooooooossssso | Pm00ff0f00f00m000m00 | CAGUUGUAAUGGCAGGCAC | 70 |
| CTGF-1005-16-13985 | 13985 | ooooooooooooossssso | Pmff000000mmm000mm0 | AGCCAGAAAGCUCAAACUU | 71 |
| CTGF-814-16-13986 | 13986 | ooooooooooooossssso | Pm000f0ffff0mmmm00m00 | CAGGCGCUCCACUCUGUGG | 72 |
| CTGF-816-16-13987 | 13987 | ooooooooooooossssso | Pm0f000f0ffmm0mmmm00 | AACAGGCGCUCCACUCUGU | 73 |
| CTGF-1001-16-13988 | 13988 | ooooooooooooossssso | Pm0000fff000mmmm0m0 | AGAAAGCUCAAACUUGAUA | 74 |
| CTGF-1173-16-13989 | 13989 | ooooooooooooossssso | Pmff0f00f00m000m0m0 | AGUUGUAAUGGCAGGCACA | 75 |
| CTGF-749-16-13990 | 13990 | ooooooooooooossssso | Pm0ffffffff0mmm00m0m | CGUGUCUUCCAGUCGGUAA | 76 |
| CTGF-792-16-13991 | 13991 | ooooooooooooossssso | Pm00ff000f00mm0mmm0 | GGACCAGGCAGUUGGCUCU | 77 |

TABLE 2-continued

| ID Number | Oligo # | AntiSense Backbone | AntiSense Chemistry | AntiSense Sequence | SEQ ID NO: |
|---|---|---|---|---|---|
| CTGF-1162-16-13992 | 13992 | ooooooooooooossssso | Pm000f0f000mmmm00m00 | CAGGCACAGGUCUUGAUGA | 78 |
| CTGF-811-16-13993 | 13993 | ooooooooooooossssso | Pmf0ffff0ffmm0m00mm0 | GCGCUCCACUCUGUGGUCU | 79 |
| CTGF-797-16-13994 | 13994 | ooooooooooooossssso | Pm0fff000ff000m00m00 | GGUCUGGACCAGGCAGUUG | 80 |
| CTGF-1175-16-13995 | 13995 | ooooooooooooossssso | Pmf0ff0f00m0m000m00 | ACAGUUGUAAUGGCAGGCA | 81 |
| CTGF-1172-16-13996 | 13996 | ooooooooooooossssso | Pmff0f00f00m000m0m00 | GUUGUAAUGGCAGGCACAG | 82 |
| CTGF-1177-16-13997 | 13997 | ooooooooooooossssso | Pm00f00ff0f00m00m000 | GGACAGUUGUAAUGGCAGG | 83 |
| CTGF-1176-16-13998 | 13998 | ooooooooooooossssso | Pm0f00ff0f00m00m0000 | GACAGUUGUAAUGGCAGGC | 84 |
| CTGF-812-16-13999 | 13999 | ooooooooooooossssso | Pm0f0ffff0fmmm0m00m0 | GGCGCUCCACUCUGUGGUC | 85 |
| CTGF-745-16-14000 | 14000 | ooooooooooooossssso | Pmfffff00ff00m000mm0 | UCUUCCAGUCGGUAAGCCG | 86 |
| CTGF-1230-16-14001 | 14001 | ooooooooooooossssso | Pm0fffff0f0m0mmmmmm0 | UGUCUCCGUACAUCUUCCU | 87 |
| CTGF-920-16-14002 | 14002 | ooooooooooooossssso | Pmffff0f0000mmm00m0 | AGCUUCGCAAGGCCUGACC | 88 |
| CTGF-679-16-14003 | 14003 | ooooooooooooossssso | Pm0fffffff0f00m0mmm0 | CACUCCUCGCAGCAUUUCC | 89 |
| CTGF-992-16-14004 | 14004 | ooooooooooooossssso | Pm00fff00f000mmm0000 | AAACUUGAUAGGCUUGGAG | 90 |
| CTGF-1045-16-14005 | 14005 | ooooooooooooossssso | Pmffff0f0000mmm0mm0 | ACUCCACAGAAUUUAGCUC | 91 |
| CTGF-1231-16-14006 | 14006 | ooooooooooooossssso | Pmf0fffff0f0m0mmmmm0 | AUGUCUCCGUACAUCUUCC | 92 |
| CTGF-991-16-14007 | 14007 | ooooooooooooossssso | Pm0fff00f000mmm00000 | AACUUGAUAGGCUUGGAGA | 93 |
| CTGF-998-16-14008 | 14008 | ooooooooooooossssso | Pm00fff000fmm00m0000 | AAGCUCAAACUUGAUAGGC | 94 |
| CTGF-1049-16-14009 | 14009 | ooooooooooooossssso | Pmf0f0ffff0m0000mmm0 | ACAUACUCCACAGAAUUUA | 95 |
| CTGF-1044-16-14010 | 14010 | ooooooooooooossssso | Pmfff0f0000m00mmm0 | CUCCACAGAAUUUAGCUCG | 96 |
| CTGF-1327-16-14011 | 14011 | ooooooooooooossssso | Pm0f0ff0ff0000mm0m00 | UGUGCUACUGAAAUCAUUU | 97 |
| CTGF-1196-16-14012 | 14012 | ooooooooooooossssso | Pm0000f0ff0mm0mmmmm0 | AAAGAUGUCAUUGUCUCCG | 98 |
| CTGF-562-16-14013 | 14013 | ooooooooooooossssso | Pmf0f0ff00f0mmm0m000 | GUGCACUGGUACUUGCAGC | 99 |
| CTGF-752-16-14014 | 14014 | ooooooooooooossssso | Pm00f0f0fffmmm00mm00 | AAACGUGUCUUCCAGUCGG | 100 |
| CTGF-994-16-14015 | 14015 | ooooooooooooossssso | Pmf000fff00m000mmm00 | UCAAACUUGAUAGGCUUGG | 101 |
| CTGF-1040-16-14016 | 14016 | ooooooooooooossssso | Pmf0000fff00mmm00m00 | ACAGAAUUUAGCUCGGUAU | 102 |
| CTGF-1984-16-14017 | 14017 | ooooooooooooossssso | Pmf0f0fffff0mmm0m00m0 | UUACAUUCUACCUAUGGUG | 103 |
| CTGF-2195-16-14018 | 14018 | ooooooooooooossssso | Pm00ff00ff00mm0m0m00 | AAACUGAUCAGCUAUAUAG | 104 |
| CTGF-2043-16-14019 | 14019 | ooooooooooooossssso | Pm0fff000f0000mmmmm0 | UAUCUGAGCAGAAUUUCCA | 105 |
| CTGF-1892-16-14020 | 14020 | ooooooooooooossssso | Pm00fff000m00mm0m00 | UUAACUUAGAUAACUGUAC | 106 |
| CTGF-1567-16-14021 | 14021 | ooooooooooooossssso | Pm0ff0fff0f0m0000m00 | UAUUACUCGUAUAAGAUGC | 107 |
| CTGF-1780-16-14022 | 14022 | ooooooooooooossssso | Pm00ff0fff00mmm0mm0 | AAGCUGUCCAGUCUAAUCG | 108 |
| CTGF-2162-16-14023 | 14023 | ooooooooooooossssso | Pm00f00000fm0mmm0m00 | UAAUAAGGCCAUUUGUUC | 109 |
| CTGF-1034-16-14024 | 14024 | ooooooooooooossssso | Pmff00fff00m0m0mmmm0 | UUUAGCUCGGUAUGUCUUC | 110 |
| CTGF-2264-16-14025 | 14025 | ooooooooooooossssso | Pmf0fffff00m000m0000 | ACACUCUCAACAAAUAAAC | 111 |
| CTGF-1032-16-14026 | 14026 | ooooooooooooossssso | Pm00fff00f0m0mmmmm0 | UAGCUCGGUAUGUCUUCAU | 112 |
| CTGF-1535-16-14027 | 14027 | ooooooooooooossssso | Pm00fffffff0mm0m0m0 | UAACCUUUCUGCUGGUACC | 113 |
| CTGF-1694-16-14028 | 14028 | ooooooooooooossssso | Pmf000000f00mmm0mm0 | UUAAGGAACAACUUGACUC | 114 |
| CTGF-1588-16-14029 | 14029 | ooooooooooooossssso | Pmf0f0ffff000m00m000 | UUACACUUCAAAUAGCAGG | 115 |

TABLE 2-continued

| ID Number | Oligo # | AntiSense Backbone | AntiSense Chemistry | AntiSense Sequence | SEQ ID NO: |
|---|---|---|---|---|---|
| CTGF-928-16-14030 | 14030 | ooooooooooooosssssso | Pmff000ff00mmmm0m000 | UCCAGGUCAGCUUCGCAAG | 116 |
| CTGF-1133-16-14031 | 14031 | ooooooooooooosssssso | Pmffffff0f00mmmm0mm0 | CUUCUUCAUGACCUCGCCG | 117 |
| CTGF-912-16-14032 | 14032 | ooooooooooooosssssso | Pm000fff00fm0m0m0m00 | AAGGCCUGACCAUGCACAG | 118 |
| CTGF-753-16-14033 | 14033 | ooooooooooooosssssso | Pm000f0f0ffmmmm00mm0 | CAAACGUGUCUUCCAGUCG | 119 |
| CTGF-918-16-14034 | 14034 | ooooooooooooosssssso | Pmfff0f0000mmm00mm00 | CUUCGCAAGGCCUGACCAU | 120 |
| CTGF-744-16-14035 | 14035 | ooooooooooooosssssso | Pmfffff00ff00m000mm00 | CUUCCAGUCGGUAAGCCGC | 121 |
| CTGF-466-16-14036 | 14036 | ooooooooooooosssssso | Pmf00ffff0f00mm00mm0 | CCGAUCUUGCGGUUGGCCG | 122 |
| CTGF-917-16-14037 | 14037 | ooooooooooooosssssso | Pmff0f0000ffmm00mm0m0 | UUCGCAAGGCCUGACCAUG | 123 |
| CTGF-1038-16-14038 | 14038 | ooooooooooooosssssso | Pm00fff00fmm0m0m00 | AGAAUUUAGCUCGGUAUGU | 124 |
| CTGF-1048-16-14039 | 14039 | ooooooooooooosssssso | Pm0f0ffff0f0000mmm00 | CAUACUCCACAGAAUUUAG | 125 |
| CTGF-1235-16-14040 | 14040 | ooooooooooooosssssso | Pm0ff0f0ffmmm0m0m0 | UGCCAUGUCUCCGUACAUC | 126 |
| CTGF-868-16-14041 | 14041 | ooooooooooooosssssso | Pm000f0ff0fm0mm0m00 | GAGGCGUUGUCAUUGGUAA | 127 |
| CTGF-1131-16-14042 | 14042 | ooooooooooooosssssso | Pmffff0f00fmm0mm0m0 | UCUUCAUGACCUCGCCGUC | 128 |
| CTGF-1043-16-14043 | 14043 | ooooooooooooosssssso | Pmff0f0000fmm00mmm00 | UCCACAGAAUUUAGCUCGG | 129 |
| CTGF-751-16-14044 | 14044 | ooooooooooooosssssso | Pm0f0f0ffffmm00mm000 | AACGUGUCUUCCAGUCGGU | 130 |
| CTGF-1227-16-14045 | 14045 | ooooooooooooosssssso | Pmfff0f0f0fmmmmm0m0 | CUCCGUACAUCUUCCUGUA | 131 |
| CTGF-867-16-14046 | 14046 | ooooooooooooosssssso | Pm0f0ff0ff0mm00m000 | AGGCGUUGUCAUUGGUAAC | 132 |
| CTGF-1128-16-14047 | 14047 | ooooooooooooosssssso | Pmf0f00ffff0mm0mm00 | UCAUGACCUCGCCGUCAGG | 133 |
| CTGF-756-16-14048 | 14048 | ooooooooooooosssssso | Pm0ff000f0f0mmmmmm00 | GGCCAAACGUGUCUUCCAG | 134 |
| CTGF-1234-16-14049 | 14049 | ooooooooooooosssssso | Pmff0f0ffffmm0m0mm0 | GCCAUGUCUCCGUACAUCU | 135 |
| CTGF-916-16-14050 | 14050 | ooooooooooooosssssso | Pmf0f0000ffm00mm0m00 | UCGCAAGGCCUGACCAUGC | 136 |
| CTGF-925-16-14051 | 14051 | ooooooooooooosssssso | Pm0ff00fffmm0000m0 | AGGUCAGCUUCGCAAGGCC | 137 |
| CTGF-1225-16-14052 | 14052 | ooooooooooooosssssso | Pmf0f0f0fffmmmm0m000 | CCGUACAUCUUCCUGUAGU | 138 |
| CTGF-445-16-14053 | 14053 | ooooooooooooosssssso | Pm00ff0000fm0m000000 | GAGCCGAAGUCACAGAAGA | 139 |
| CTGF-446-16-14054 | 14054 | ooooooooooooosssssso | Pm000ff0000mm0m000000 | GGAGCCGAAGUCACAGAAG | 140 |
| CTGF-913-16-14055 | 14055 | ooooooooooooosssssso | Pm0000fff00mm0m0m0m0 | CAAGGCCUGACCAUGCACA | 141 |
| CTGF-997-16-14056 | 14056 | ooooooooooooosssssso | Pmfff000ffm00m000m0 | AGCUCAAACUUGAUAGGCU | 142 |
| CTGF-277-16-14057 | 14057 | ooooooooooooosssssso | Pmf0f00ffff00mm00m00 | CUGCAGUUCUGGCCGACGG | 143 |
| CTGF-1052-16-14058 | 14058 | ooooooooooooosssssso | Pm0f0f0f0ffmm0m00000 | GGUACAUACUCCACAGAAU | 144 |
| CTGF-887-16-14059 | 14059 | ooooooooooooosssssso | Pmf0fffffff00mmm0m00 | CUGCUUCUCUAGCCUGCAG | 145 |
| CTGF-914-16-14060 | 14060 | ooooooooooooosssssso | Pmf0000fff00mm0m0m00 | GCAAGGCCUGACCAUGCAC | 146 |
| CTGF-1039-16-14061 | 14061 | ooooooooooooosssssso | Pm0000fff00mmm00m0m0 | CAGAAUUUAGCUCGGUAUG | 147 |
| CTGF-754-16-14062 | 14062 | ooooooooooooosssssso | Pmf000f0f0fmmmmm00m0 | CCAAACGUGUCUUCCAGUC | 148 |
| CTGF-1130-16-14063 | 14063 | ooooooooooooosssssso | Pmff0f00ffmmmm0mm0 | CUUCAUGACCUCGCCGUCA | 149 |
| CTGF-919-16-14064 | 14064 | ooooooooooooosssssso | Pmffff0f0000mmm00mm0 | GCUUCGCAAGGCCUGACCA | 150 |
| CTGF-922-16-14065 | 14065 | ooooooooooooosssssso | Pmf00ffff0f0000mmm00 | UCAGCUUCGCAAGGCCUGA | 151 |
| CTGF-746-16-14066 | 14066 | ooooooooooooosssssso | Pmffffff00fm0m000m0 | GUCUUCCAGUCGGUAAGCC | 152 |
| CTGF-993-16-14067 | 14067 | ooooooooooooosssssso | Pm000fff00f000mmm000 | CAAACUUGAUAGGCUUGGA | 153 |

TABLE 2-continued

| ID Number | Oligo # | AntiSense Backbone | AntiSense Chemistry | AntiSense Sequence | SEQ ID NO: |
|---|---|---|---|---|---|
| CTGF-825-16-14068 | 14068 | ooooooooooooossssso | Pm0ffff0000m000m0m0 | AGGUCUUGGAACAGGCGCU | 154 |
| CTGF-926-16-14069 | 14069 | ooooooooooooossssso | Pm000ff00ffmmm00000 | CAGGUCAGCUUCGCAAGGC | 155 |
| CTGF-923-16-14070 | 14070 | ooooooooooooossssso | Pmff00ffff0m0000mmm0 | GUCAGCUUCGCAAGGCCUG | 156 |
| CTGF-866-16-14071 | 14071 | ooooooooooooossssso | Pm0f0ff0ff0mm0m00m0 | GGCGUUGUCAUUGGUAACC | 157 |
| CTGF-563-16-14072 | 14072 | ooooooooooooossssso | Pmf0f0ff00m0mmm0m00 | CGUGCACUGGUACUUGCAG | 158 |
| CTGF-823-16-14073 | 14073 | ooooooooooooossssso | Pmfffff0000f000m0mmm0 | GUCUUGGAACAGGCGCUCC | 159 |
| CTGF-1233-16-14074 | 14074 | ooooooooooooossssso | Pmf0f0ffff0m0m0mmm0 | CCAUGUCUCCGUACAUCUU | 160 |
| CTGF-924-16-14075 | 14075 | ooooooooooooossssso | Pm0ff00ffff0m0000mm0 | GGUCAGCUUCGCAAGGCCU | 161 |
| CTGF-921-16-14076 | 14076 | ooooooooooooossssso | Pm00ffff0f0000mmm000 | CAGCUUCGCAAGGCCUGAC | 162 |
| CTGF-443-16-14077 | 14077 | ooooooooooooossssso | Pmff0000ff0m00000000 | GCCGAAGUCACAGAAGAGG | 163 |
| CTGF-1041-16-14078 | 14078 | ooooooooooooossssso | Pm0f0000fff00mmm00m0 | CACAGAAUUUAGCUCGGUA | 164 |
| CTGF-1042-16-14079 | 14079 | ooooooooooooossssso | Pm0f0000ffm0mmm000 | CCACAGAAUUUAGCUCGGU | 165 |
| CTGF-755-16-14080 | 14080 | ooooooooooooossssso | Pmff000f0f0mmmmmm000 | GCCAAACGUGUCUUCCAGU | 166 |
| CTGF-467-16-14081 | 14081 | ooooooooooooossssso | Pmf0f00ffff0mmm00m0 | GCCGAUCUUGCGGUUGGCC | 167 |
| CTGF-995-16-14082 | 14082 | ooooooooooooossssso | Pmff000fff00m000mmm0 | CUCAAACUUGAUAGGCUUG | 168 |
| CTGF-927-16-14083 | 14083 | ooooooooooooossssso | Pmf000ff00fmmm0m0000 | CCAGGUCAGCUUCGCAAGG | 169 |
| SPP1-1091-16-14131 | 14131 | ooooooooooooossssso | Pmff00ff000m0m0000m0 | UUUGACUAAAUGCAAAGUG | 170 |
| PPIB--16-14188 | 14188 | ooooooooooooossssso | Pm0fffff0f00mm000mm0 | UGUUUUUGUAGCCAAAUCC | 171 |
| PPIB--17-14189 | 14189 | ooooooooooooossssso | Pm0fffff0f00mm000mm0 | UGUUUUUGUAGCCAAAUCC | 172 |
| PPIB--18-14190 | 14190 | ooooooooooooossssso | Pm0fffff0f00mm000mm0 | UGUUUUUGUAGCCAAAUCC | 173 |
| pGL3-1172-16-14386 | 14386 | ooooooooooooossssso | Pm00ff0f0ffm0mm00m0 | AAAUCGUAUUUGUCAAUCA | 174 |
| pGL3-1172-16-14387 | 14387 | ooooooooooooossssso | Pm00ff0f0ffm0mm00m0 | AAAUCGUAUUUGUCAAUCA | 175 |
| miR-122--23-14391 | 14391 | | | | |
| | 14084 | ooooooooooooossssso | Pmff00fff0f000000m00 | UCUAAUUCAUGAGAAAUAC | 616 |
| | 14085 | ooooooooooooossssso | Pm00ff00fffm000000m0 | UAAUUGACCUCAGAAGAUG | 617 |
| | 14086 | ooooooooooooossssso | Pmff00ff00fmmm000000 | UUUAAUUGACCUCAGAAGA | 618 |
| | 14087 | ooooooooooooossssso | Pm0ff00ffff000000m00 | AAUUGACCUCAGAAGAUGC | 619 |
| | 14088 | ooooooooooooossssso | Pmf00ff00ffmm0000000 | UUAAUUGACCUCAGAAGAU | 620 |
| | 14089 | ooooooooooooossssso | Pmff00ffff000000m0m0 | AUUGACCUCAGAAGAUGCA | 621 |
| | 14090 | ooooooooooooossssso | Pmf0fff0ff00mmm0mm0 | UCAUCCAGCUGACUCGUUU | 622 |
| | 14091 | ooooooooooooossssso | Pm0fff0ff0000m0m00 | AGAUUCAUCAGAAUGGUGA | 623 |
| | 14092 | ooooooooooooossssso | Pm00ffff00fmm0m000m0 | UGACCUCAGUCCAUAAACC | 624 |
| | 14093 | ooooooooooooossssso | Pm0f00f0000mmm0mm00 | AAUGGUGAGACUCAUCAGA | 625 |
| | 14094 | ooooooooooooossssso | Pmff00ffff00mmm0m000 | UUUGACCUCAGUCCAUAAA | 626 |
| | 14095 | ooooooooooooossssso | Pmff0f00ff0m0000mmm0 | UUCAUGGCUGUGAAAUUCA | 627 |
| | 14096 | ooooooooooooossssso | Pm0f00f0000mmm0mm00 | GAAUGGUGAGACUCAUCAG | 628 |
| | 14097 | ooooooooooooossssso | Pm00ffffff0mmm0m0m00 | UGGCUUUCCGCUUAUAUAA | 629 |
| | 14098 | ooooooooooooossssso | Pmf00fffff0mmm0m0m0 | UUGGCUUUCCGCUUAUAUA | 630 |

TABLE 2-continued

| ID Number | Oligo # | AntiSense Backbone | AntiSense Chemistry | AntiSense Sequence | SEQ ID NO: |
|---|---|---|---|---|---|
| | 14099 | ooooooooooooosssssso | Pmf0fff0f0f00mm0m000 | UCAUCCAUGUGGUCAUGGC | 631 |
| | 14100 | ooooooooooooosssssso | Pmf0f00ff0f00mmmmm00 | AUGUGGUCAUGGCUUUCGU | 632 |
| | 14101 | ooooooooooooosssssso | Pmf00ff0f00mmmmm0mm0 | GUGGUCAUGGCUUUCGUUG | 633 |
| | 14102 | ooooooooooooosssssso | Pmff00fffffmmmm0m00 | AUUGGCUUUCCGCUUAUAU | 634 |
| | 14103 | ooooooooooooosssssso | Pm00f0f0000mmmm000m0 | AAAUACGAAAUUUCAGGUG | 635 |
| | 14104 | ooooooooooooosssssso | Pm000f0f0000mmmm000 | AGAAAUACGAAAUUUCAGG | 636 |
| | 14105 | ooooooooooooosssssso | Pm00ff0f00fmmmm0mm00 | UGGUCAUGGCUUUCGUUGG | 637 |
| | 14106 | ooooooooooooosssssso | Pmf0ff0fff0m0m00mm00 | AUAUCAUCCAUGUGGUCAU | 638 |
| | 14107 | ooooooooooooosssssso | Pm0f0f0000fmmmm000m00 | AAUACGAAAUUUCAGGUGU | 639 |
| | 14108 | ooooooooooooosssssso | Pm0ff000000mm0mmm00 | AAUCAGAAGGCGCGUUCAG | 640 |
| | 14109 | ooooooooooooosssssso | Pmfff0f000000m0m0000 | AUUCAUGAGAAAUACGAAA | 641 |
| | 14110 | ooooooooooooosssssso | Pmf0fff0f0000000m0 | CUAUUCAUGAGAGAAUAAC | 642 |
| | 14111 | ooooooooooooosssssso | Pmfff0ff000mmm0mmm00 | UUUCGUUGGACUUACUUGG | 643 |
| | 14112 | ooooooooooooosssssso | Pmf0ffffff0fm0mm00mm0 | UUGCUCUCAUCAUUGGCUU | 644 |
| | 14113 | ooooooooooooosssssso | Pmff00fffffmmmmmm0 | UUCAACUCCUCGCUUUCCA | 645 |
| | 14114 | ooooooooooooosssssso | Pm00ff0ff00mm0m0mm00 | UGACUAUCAAUCACAUCGG | 646 |
| | 14115 | ooooooooooooosssssso | Pm0f0f0ff0mmm00mmm0 | AGAUGCACUAUCUAAUUCA | 647 |
| | 14116 | ooooooooooooosssssso | Pm0f000f0f0m0mmm00m0 | AAUAGAUACACAUUCAACC | 648 |
| | 14117 | ooooooooooooosssssso | Pmffffff0f0000m000m0 | UUCUUCUAUAGAAUGAACA | 649 |
| | 14118 | ooooooooooooosssssso | Pm0ff0ff000m00mm00m0 | AAUUGCUGGACAACCGUGG | 650 |
| | 14119 | ooooooooooooosssssso | Pmf0fffffff0m0m0m0000 | UCGCUUUCCAUGUGUGAGG | 651 |
| | 14120 | ooooooooooooosssssso | Pm00fff000fm0mmmm0m0 | UAAUCUGGACUGCUUGUGG | 652 |
| | 14121 | ooooooooooooosssssso | Pmf0f0fff00mm00m0000 | ACACAUUCAACCAAUAAAC | 653 |
| | 14122 | ooooooooooooosssssso | Pmfff0ffff0m00mm0mm0 | ACUCGUUUCAUAACUGUCC | 654 |
| | 14121 | ooooooooooooosssssso | Pmf00fff000mm0mmm0m0 | AUAAUCUGGACUGCUUGUG | 655 |
| | 14124 | ooooooooooooosssssso | Pmffff0fff0m0m00mmm0 | UUUCCGCUUAUAUAAUCUG | 656 |
| | 14125 | ooooooooooooosssssso | Pm0fff00ff0m0m0m0m0 | UGUUUAACUGGUAUGGCAC | 657 |
| | 14126 | ooooooooooooosssssso | Pm0f0000f000m0m000m0 | UAUAGAAUGAACAUAGACA | 658 |
| | 14127 | ooooooooooooosssssso | Pmffffff00fm0m0mmm0 | UUUCCUUGGUCGGCGUUUG | 659 |
| | 14128 | ooooooooooooosssssso | Pmf0f0f0ff0mmm00mmm0 | GUAUGCACCAUUCAACUCC | 660 |
| | 14129 | ooooooooooooosssssso | Pm00ff0ff0m0m0mmm0 | UCGGCCAUCAUAUGUGUCU | 661 |
| | 14130 | ooooooooooooosssssso | Pm0fff000ff0mmm0m000 | AAUCGGACUGCUUGUGGC | 662 |
| | 14132 | ooooooooooooosssssso | Pm0ff0000f0mm0mm00 | ACAUCGGAAUGCUCAUUGC | 663 |
| | 14133 | ooooooooooooosssssso | Pm00ffff00mm0m00m0 | AAGUUCCUGACUAUCAAUC | 664 |
| | 14134 | ooooooooooooosssssso | Pm0ff000f0m0000m00 | UUGACUAAAUGCAAAGUGA | 665 |
| | 14135 | ooooooooooooosssssso | Pm0fff0ff000mm0m00 | AGACUCAUCAGACUGGUGA | 666 |
| | 14136 | ooooooooooooosssssso | Pmf0f0f0f0fmm0mm0m0 | UCAUAUGUGUCUACUGUGG | 667 |
| | 14137 | ooooooooooooosssssso | Pmf0ffffff0fmm0m00m00 | AUGUCCUCGUCUGUAGCAU | 668 |

TABLE 2-continued

| ID Number | Oligo # | AntiSense Backbone | AntiSense Chemistry | AntiSense Sequence | SEQ ID NO: |
|---|---|---|---|---|---|
| | 14138 | ooooooooooooossssssso | Pm00fff0f00mm00mmmm0 | GAAUUCACGGCUGACUUUG | 669 |
| | 14139 | ooooooooooooossssssso | Pmf0fffff000mmm000m0 | UUAUUUCCAGACUCAAAUA | 670 |
| | 14140 | ooooooooooooossssssso | Pm000ff0f000mm000mm0 | GAAGCCACAAACUAAACUA | 671 |
| | 14141 | ooooooooooooossssssso | Pmffff0ff000mmm0mmm0 | CUUUCGUUGGACUUACUUG | 672 |
| | 14142 | ooooooooooooossssssso | Pmff0f0000mmmmmm000 | GUCUGCGAAACUUCUUAGA | 673 |
| | 14143 | ooooooooooooossssssso | Pm0f0fff0ff0mmmmm0m0 | AAUGCUCAUUGCUCUCAUC | 674 |
| | 14144 | ooooooooooooossssssso | Pmf0f0ff0ffm00mmm0m0 | AUGCACUAUCUAAUUCAUG | 675 |
| | 14145 | ooooooooooooossssssso | Pmff0f0f0mm0mmm000 | CUUGUAUGCACCAUUCAAC | 676 |
| | 14146 | ooooooooooooossssssso | Pm00fff0ffm0m00mm00 | UGACUCGUUUCAUAACUGU | 677 |
| | 14147 | ooooooooooooossssssso | Pmff00f0fffm00mmm0m0 | UUCAGCACUCUGGUCAUCC | 678 |
| | 14148 | ooooooooooooossssssso | Pm00fff0f00mm0m00000 | AAAUUCAUGGCUGUGGAAU | 679 |
| | 14149 | ooooooooooooossssssso | Pmf0fff00ff00m000mm0 | ACAUUCAACCAAUAAACUG | 680 |
| | 14150 | ooooooooooooossssssso | Pm0f0f0fff00mm00m000 | UACACAUUCAACCAAUAAA | 681 |
| | 14151 | ooooooooooooossssssso | Pmff00ff0ffmmm000mm0 | AUUAGUUAUUUCCAGACUC | 682 |
| | 14152 | ooooooooooooossssssso | Pmffff0fff0m00000000 | UUUCUAUUCAUGAGAGAAU | 683 |
| | 14153 | ooooooooooooossssssso | Pmff00ff0ff00m000mm0 | UUCGGUUGCUGGCAGGUCC | 684 |
| | 14154 | ooooooooooooossssssso | Pm0f0f0f0000m00m0mm0 | CAUGUGUGAGGUGAUGUCC | 685 |
| | 14155 | ooooooooooooossssssso | Pmf0ff0fff00mmmmmm00 | GCACCAUUCAACUCCUCGC | 686 |
| | 14156 | ooooooooooooossssssso | Pm0fff00ff00mmm0mm0 | CAUCCAGCUGACUCGUUUC | 687 |
| | 14157 | ooooooooooooossssssso | Pmffffff0fff0m0m00mm0 | CUUUCCGCUUAUAUAAUCU | 688 |
| | 14158 | ooooooooooooossssssso | Pm0ff0f0ff0000m0mmm0 | AAUCACAUCGGAAUGCUCA | 689 |
| | 14159 | ooooooooooooossssssso | Pmf0f0ff00fm0mmmmmm00 | ACACAUUAGUUAUUUCCAG | 690 |
| | 14160 | ooooooooooooossssssso | Pmfff0f0000m000m0m00 | UUCUAUAGAAUGAACAUAG | 691 |
| | 14161 | ooooooooooooossssssso | Pm0f00f00f00mmm0m0m0 | UACAGUGAUAGUUUGCAUU | 692 |
| | 14162 | ooooooooooooossssssso | Pmf000f00ff00m0mm0m0 | AUAAGCAAUUGACACCACC | 693 |
| | 14163 | ooooooooooooossssssso | Pmff0ff00ff0mm000m00 | UUUAUUAAUUGCUGGACAA | 694 |
| | 14164 | ooooooooooooossssssso | Pmf0ff0000fmmmm0000 | UCAUCAGAGUCGUUCGAGU | 695 |
| | 14165 | ooooooooooooossssssso | Pmf000ff0f0mm0mm0m0 | AUAAACCACACUAUCACCU | 696 |
| | 14166 | ooooooooooooossssssso | Pm0ff0ff00mmmmmm0m0 | UCAUCAUUGGCUUUCCGCU | 697 |
| | 14167 | ooooooooooooossssssso | Pmfffff00fm0mm00mm0 | AGUUCCUGACUAUCAAUCA | 698 |
| | 14168 | ooooooooooooossssssso | Pmff0f00ff00mmmm0000 | UUCACGGCUGACUUUGGAA | 699 |
| | 14169 | ooooooooooooossssssso | Pmffff0f00f00m000mm0 | UUCUCAUGGUAGUGAGUUU | 700 |
| | 14170 | ooooooooooooossssssso | Pm0ff00fff0mmm00mm00 | AAUCAGCCUGUUUAACUGG | 701 |
| | 14171 | ooooooooooooossssssso | Pm0ffff00f0mmmm00m0 | GGUUUCAGCACUCUGGUCA | 702 |
| | 14172 | ooooooooooooossssssso | Pmff0000f0fmm0mmm0m0 | AUCGGAAUGCUCAUUGCUC | 703 |
| | 14173 | ooooooooooooossssssso | Pm00ff0f0000mmm0m000 | UGGCUGUGGAAUUCACGGC | 704 |
| | 14174 | ooooooooooooossssssso | Pm000f00ff00m0mm0mm0 | UAAGCAAUUGACACCACCA | 705 |
| | 14175 | ooooooooooooossssssso | Pm00fffff0f00m00m000 | CAAUUCUCAUGGUAGUGAG | 706 |

TABLE 2-continued

| ID Number | Oligo # | AntiSense Backbone | AntiSense Chemistry | AntiSense Sequence | SEQ ID NO: |
|---|---|---|---|---|---|
| | 14176 | ooooooooooooosssssso | Pm00fffff0fm000mmm00 | UGGCUUUCGUUGGACUUAC | 707 |
| | 14177 | ooooooooooooosssssso | Pm0ff00f00fm00mmm0m0 | AAUCAGUGACCAGUUCAUC | 708 |
| | 14178 | ooooooooooooosssssso | Pmfff0f000mm0m0mm00 | AGUCCAUAAACCACACUAU | 709 |
| | 14179 | ooooooooooooosssssso | Pm00f0ffff00mm0mmm00 | CAGCACUCUGGUCAUCCAG | 710 |
| | 14180 | ooooooooooooosssssso | Pm0ff00ff0f0mm0000m0 | UAUCAAUCACAUCGGAAUG | 711 |
| | 14181 | ooooooooooooosssssso | Pmfff0f00ff00mmmm000 | AUUCACGGCUGACUUUGGA | 712 |
| | 14182 | ooooooooooooosssssso | Pmf000f0f0f0mmm00mm0 | AUAGAUACACAUUCAACCA | 713 |
| | 14183 | ooooooooooooosssssso | Pmffff000ffm000m0000 | UUUCCAGACUCAAAUAGAU | 714 |
| | 14184 | ooooooooooooosssssso | Pmf00ff0ff000m00mm00 | UUAAUUGCUGGACAACCGU | 715 |
| | 14185 | ooooooooooooosssssso | Pm0ff00ff0fm000m00m0 | UAUUAAUUGCUGGACAACC | 716 |
| | 14186 | ooooooooooooosssssso | Pmff0fff000mm00m000 | AGUCGUUCGAGUCAAUGGA | 717 |
| | 14187 | ooooooooooooosssssso | Pmff0ff00f000mmm0m00 | GUUGCUGGCAGGUCCGUGG | 718 |

TABLE 2: Antisense backbone, chemistry, and sequence information. o: phosphodiester; s: phosphorothioate; P: 5' phosphorylation; 0: 2'-OH; F: 2'-fluoro; m: 2' O-methyl; +: LNA modification. Capital letters in the sequence signify ribonucleotides, lower case letters signify deoxyribonucleotides.

TABLE 3

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| APOB-10167-20-12138 | 12138 | chl | oooooooooooooooooooso | 00000000000000000000 | GUCAUCACACUGAAUACCAAU | 176 |
| APOB-10167-20-12139 | 12139 | chl | oooooooooooooooooooso | 00000000000000000000 | GUGAUCAGACUCAAUACGAAU | 177 |
| MAP4K4-2931-13-12266 | 12266 | chl | ooooooooooosso | mm0m00000mmm0 | CUGUGGAAGUCUA | 178 |
| MAP4K4-2931-16-12293 | 12293 | chl | ooooooooooosso | mm0m00000mmm0 | CUGUGGAAGUCUA | 179 |
| MAP4K4-2931-16-12383 | 12383 | chl | ooooooooooooo | mm0m00000mmm0 | CUGUGGAAGUCUA | 180 |
| MAP4K4-2931-16-12384 | 12384 | chl | ooooooooooooo | mm0m00000mmm0 | CUGUGGAAGUCUA | 181 |
| MAP4K4-2931-16-12385 | 12385 | chl | ooooooooooooo | mm0m00000mmm0 | CUGUGGAAGUCUA | 182 |
| MAP4K4-2931-16-12386 | 12386 | chl | ooooooooooosso | 0mm0m00000mmm0 | CUGUGGAAGUCUA | 183 |
| MAP4K4-2931-16-12387 | 12387 | chl | ooooooooooooo | mm0m00000mmm0 | CUGUGGAAGUCUA | 184 |
| MAP4K4-2931-15-12388 | 12388 | chl | ooooooooooooo | mm0m00000mmm0 | CUGUGGAAGUCUA | 185 |
| MAP4K4-2931-13-12432 | 12432 | chl | ooooooooooooo | DY547mm0m00000mmm0 | CUGUGGAAGUCUA | 186 |
| MAP4K4-2931-13-12266.2 | 12266.2 | chl | ooooooooooss | mm0m00000mmm0 | CUGUGGAAGUCUA | 187 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| APOB--21-12434 | 12434 | chl | oooooooooooooooooooso | 00000000000000000000 | GUCAUCACACUGAAUACCAAU | 188 |
| APOB--21-12435 | 12435 | chl | oooooooooooooooooooso | DY54700000000000000000000 | GUGAUCAGACUCAAUACGAAU | 189 |
| MAP4K4-2931-16-12451 | 12451 | chl | ooooooooooooss | 0mm0m00000mmm0 | CUGUGGAAGUCUA | 190 |
| MAP4K4-2931-16-12452 | 12452 | chl | ooooooooooooss | mm0m00000mmm0 | CUGUGGAAGUCUA | 191 |
| MAP4K4-2931-16-12453 | 12453 | chl | ooooooooooooss | mm0m00000mmm0 | CUGUGGAAGUCUA | 192 |
| MAP4K4-2931-17-12454 | 12454 | chl | ooooooooooooss | 0mm0m00000mmm0 | CUGUGGAAGUCUA | 193 |
| MAP4K4-2931-17-12455 | 12455 | chl | ooooooooooooss | mm0m00000mmm0 | CUGUGGAAGUCUA | 194 |
| MAP4K4-2931-19-12456 | 12456 | chl | ooooooooooooss | mm0m00000mmm0 | CUGUGGAAGUCUA | 195 |
| --27-12480 | 12480 | chl | ooooooooooooooooooooooooosso | DY547mm0f000f0055f5f00mm00000m000 | UCAUAGGUAACCUCUGGUUGAAAGUGA | 196 |
| --27-12481 | 12481 | chl | ooooooooooooooooooooooooosso | DY547mm05f05000f05ff0m00000000m00 | CGGCUACAGGUGCUUAUGAAGAAAGUA | 197 |
| APOB-10167-21-12505 | 12505 | chl | oooooooooooooooooooos | 000000000000000000000000 | GUCAUCACACUGAAUACCAAU | 198 |
| APOB-10167-21-12506 | 12506 | chl | oooooooooooooooooooos | 000000000000000000000000 | GUGAUCAGACUCAAUACGAAU | 199 |
| MAP4K4-2931-16-12539 | 12539 | chl | ooooooooooooss | DY547mm0m00000mmm0 | CUGUGGAAGUCUA | 200 |
| APOB-10167-21-12505.2 | 12505.2 | chl | ooooooooooooooooooooso | 00000000000000000000 | GUCAUCACACUGAAUACCAAU | 201 |
| APOB-10167-21-12506.2 | 12506.2 | chl | ooooooooooooooooooooso | 00000000000000000000 | GUGAUCAGACUCAAUACGAAU | 202 |
| MAP4K4--13-12565 | 12565 | Chl | ooooooooooooo | m0m0000m0mmm0 | UGUAGGAUGCUA | 203 |
| MAP4K4-2931-16-12386.2 | 12386.2 | chl | ooooooooooooo | 0mm0m00000mmm0 | CUGUGGAAGUCUA | 204 |
| MAP4K4-2931-13-12815 | 12815 | chl | ooooooooooooo | m0m0m0m0m0m0m0m0m0m0m0m0 | CUGUGGAAGUCUA | 205 |
| APOB--13-12957 | 12957 | Chl TEG | ooooooooooooss | 0mmmmmmmmmmmm | ACUGAAUACCAAU | 206 |
| MAP4K4--16-12983 | 12983 | chl | ooooooooooooss | mm0m00000mmm0 | CUGUGGAAGUCUA | 207 |
| MAP4K4--16-12984 | 12984 | Chl | ooooooooooooooo | mm0m00000mmm0 | CUGUGGAAGUCUA | 208 |
| MAP4K4--16-12985 | 12985 | chl | ooooooooooooso | mmmmmmmmmmmm | CUGUGGAAGUCUA | 209 |
| MAP4K4--16-12986 | 12986 | chl | ooooooooooooso | mmmmmmmmmmmm | CUGUGGAAGUCUA | 210 |
| MAP4K4--16-12987 | 12987 | chl | ooooooooooooso | mm0m00000mmm0 | CUGUGGAAGUCUA | 211 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| MAP4K4--16-12988 | 12988 | chl | oooooooooosso | mm0m00000mmm0 | CUGUGGAAGUCUA | 212 |
| MAP4K4--16-12989 | 12989 | chl | oooooooooosso | mm0m00000mmm0 | CUGUGGAAGUCUA | 213 |
| MAP4K4--16-12990 | 12990 | chl | oooooooooosso | mm0m00000mmm0 | CUGUGGAAGUCUA | 214 |
| MAP4K4--16-12991 | 12991 | chl | oooooooooosso | mm0m00000mmm0 | CUGUGGAAGUCUA | 215 |
| MAP4K4--16-12992 | 12992 | chl | oooooooooosso | mm0m00000mmm0 | CUGUGGAAGUCUA | 216 |
| MAP4K4--16-12993 | 12993 | chl | oooooooooosso | mm0m00000mmm0 | CUGUGGAAGUCUA | 217 |
| MAP4K4--16-12994 | 12994 | chl | oooooooooosso | mm0m00000mmm0 | CUGUGGAAGUCUA | 218 |
| MAP4K4--16-12995 | 12995 | chl | oooooooooosso | mm0m00000mmm0 | CUGUGGAAGUCUA | 219 |
| MAP4K4-2931-19-13012 | 13012 | chl | oooooooooooooooooooo | 000000000000000000000 | AGAGUUCUGUGGAAGUCUA | 220 |
| MAP4K4-2931-19-13016 | 13016 | chl | oooooooooooooooooooo | DY547000000000000000000000 | AGAGUUCUGUGGAAGUCUA | 221 |
| PPIB--13-13021 | 13021 | Chl | oooooooooooo | 0mmm00mm0m000 | AUUUGGCUACAAA | 222 |
| pGL3-1172-13-13038 | 13038 | chl | oooooooooooo | 00m000m0m00mmm | ACAAAUACGAUUU | 223 |
| pGL3-1172-13-13040 | 13040 | chl | oooooooooooo | DY5470m000m0m00mmm | ACAAAUACGAUUU | 224 |
| --16-13047 | 13047 | Chl | oooooooooooooo | mm0m00000mmm0 | CUGUGGAAGUCUA | 225 |
| SOD1-530-13-13090 | 13090 | chl | oooooooooooo | 00m00000000m0 | AAUGAAGAAAGUA | 226 |
| SOD1-523-13-13091 | 13091 | chl | oooooooooooo | 000m00000m000 | AGGUGGAAAUGAA | 227 |
| SOD1-535-13-13092 | 13092 | chl | oooooooooooo | 000000m0m0000 | AGAAAGUACAAAG | 228 |
| SOD1-536-13-13093 | 13093 | chl | oooooooooooo | 00000m0m00000 | GAAAGUACAAAGA | 229 |
| SOD1-396-13-13094 | 13094 | chl | oooooooooooo | 0m0m00mm0mm00 | AUGUGACUGCUGA | 230 |
| SOD1-385-13-13095 | 13095 | chl | oooooooooooo | 000mmm000m00m | AGACUUGGGCAAU | 231 |
| SOD1-195-13-13096 | 13096 | chl | oooooooooooo | 0mmmm000m0000 | AUUUCGAGCAGAA | 232 |
| APOB-4314-13-13115 | 13115 | Chl | oooooooooooo | 0mmm0000000m0 | AUCUGGAGAAACA | 233 |
| APOB-3384-13-13116 | 13116 | Chl | oooooooooooo | mm0000m000000 | UCAGAACAAGAAA | 234 |
| APOB-3547-13-13117 | 13117 | Chl | oooooooooooo | 00mmm0mmm0mm0 | GACUCAUCUGCUA | 235 |
| APOB-4318-13-13118 | 13118 | Chl | oooooooooooo | 0000000m0m0m | GGAGAAACAACAU | 236 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| APOB-3741-13-13119 | 13119 | Chl | oooooooooooo | 00mmmmmm000m0 | AGUCCCUCAAACA | 237 |
| PPIB--16-13136 | 13136 | Chl | oooooooooooo | 00mm0m00000m0 | GGCUACAAAAACA | 238 |
| APOB-4314-15-13154 | 13154 | chl | oooooooooooooo | 000mmm0000000m0 | AGAUCUGGAGAAACA | 239 |
| APOB-3547-15-13155 | 13155 | chl | oooooooooooooo | m000mmm0mmm0mm0 | UGGACUCAUCUGCUA | 240 |
| APOB-4318-15-13157 | 13157 | chl | oooooooooooooo | mm0000000m00m0m | CUGGAGAAACAACAU | 241 |
| APOB-3741-15-13158 | 13158 | chl | oooooooooooooo | 0000mmmmmm000m0 | AGAGUCCCUCAAACA | 242 |
| APOB--13-13159 | 13159 | chl | oooooooooooo | 0mm000m0mm00m | ACUGAAUACCAAU | 243 |
| APOB--15-13160 | 13160 | chl | oooooooooooooo | 0m0mm000m0mm00m | ACACUGAAUACCAAU | 244 |
| SOD1-530-16-13163 | 13163 | chl | oooooooooooo | 00m00000000m0 | AAUGAAGAAAGUA | 245 |
| SOD1-523-16-13164 | 13164 | chl | oooooooooooo | 000m00000m000 | AGGUGGAAAUGAA | 246 |
| SOD1-535-16-13165 | 13165 | chl | oooooooooooo | 000000m0m0000 | AGAAAGUACAAAG | 247 |
| SOD1-536-16-13166 | 13166 | chl | oooooooooooo | 00000m0m00000 | GAAAGUACAAAGA | 248 |
| SOD1-396-16-13167 | 13167 | chl | oooooooooooo | 0m0m00mm0mm00 | AUGUGACUGCUGA | 249 |
| SOD1-385-16-13168 | 13168 | chl | oooooooooooo | 000mmm000m00m | AGACUUGGGCAAU | 250 |
| SOD1-195-16-13169 | 13169 | chl | oooooooooooo | 0mmmm000m0000 | AUUUCGAGCAGAA | 251 |
| pGL3-1172-16-13170 | 13170 | chl | oooooooooooo | 0m000m0m00mmm | ACAAAUACGAUUU | 252 |
| pGL3-1172-16-13171 | 13171 | chl | oooooooooooo | DY5470m000m0m00mmm | ACAAAUACGAUUU | 253 |
| MAP4k4-2931-19-13189 | 13189 | chl | oooooooooooooooooooo | 000000000000000000000 | AGAGUUCUGUGGAAGUCUA | 254 |
| CTGF-1222-13-13190 | 13190 | Chl | oooooooooooo | 0m0000000m0m0 | ACAGGAAGAUGUA | 255 |
| CTGF-813-13-13192 | 13192 | Chl | oooooooooooo | 000m0000m0mmm | GAGUGGAGCGCCU | 256 |
| CTGF-747-13-13194 | 13194 | Chl | oooooooooooo | m00mm000000m0 | CGACUGGAAGACA | 257 |
| CTGF-817-13-13196 | 13196 | Chl | oooooooooooo | 0000m0mmm0mmm | GGAGCGCCUGUUC | 258 |
| CTGF-1174-13-13198 | 13198 | Chl | oooooooooooo | 0mm0m0m00mm0 | GCCAUUACAACUG | 259 |
| CTGF-1005-13-13200 | 13200 | Chl | oooooooooooo | 000mmmmmm00mm | GAGCUUUCUGGCU | 260 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-814-13-13202 | 13202 | Chl | oooooooooooo | 00m0000m0mmm0 | AGUGGAGCGCCUG | 261 |
| CTGF-816-13-13204 | 13204 | Chl | oooooooooooo | m0000m0mmm0mm | UGGAGCGCCUGUU | 262 |
| CTGF-1001-13-13206 | 13206 | Chl | oooooooooooo | 0mmm000mmmmmm | GUUUGAGCUUUCU | 263 |
| CTGF-1173-13-13208 | 13208 | Chl | oooooooooooo | m0mm0mm0m00mm | UGCCAUUACAACU | 264 |
| CTGF-749-13-13210 | 13210 | Chl | oooooooooooo | 0mm000000m0m0 | ACUGGAAGACACG | 265 |
| CTGF-792-13-13212 | 13212 | Chl | oooooooooooo | 00mm0mmm00mmm | AACUGCCUGGUCC | 266 |
| CTGF-1162-13-13214 | 13214 | Chl | oooooooooooo | 000mmm0m0mmm0 | AGACCUGUGCCUG | 267 |
| CTGF-811-13-13216 | 13216 | Chl | oooooooooooo | m0000m0000m0m | CAGAGUGGAGCGC | 268 |
| CTGF-797-13-13218 | 13218 | Chl | oooooooooooo | mmm00mmm000mm | CCUGGUCCAGACC | 269 |
| CTGF-1175-13-13220 | 13220 | Chl | oooooooooooo | mm0mm0m00mmm0 | CCAUUACAACUGU | 270 |
| CTGF-1172-13-13222 | 13222 | Chl | oooooooooooo | mm0mm0mm0mm00m | CUGCCAUUACAAC | 271 |
| CTGF-1177-13-13224 | 13224 | Chl | oooooooooooo | 0mm0m00mm0mmm | AUUACAACUGUCC | 272 |
| CTGF-1176-13-13226 | 13226 | Chl | oooooooooooo | m0mm0m00mm0mm | CAUUACAACUGUC | 273 |
| CTGF-812-13-13228 | 13228 | Chl | oooooooooooo | 0000m0000m0mm | AGAGUGGAGCGCC | 274 |
| CTGF-745-13-13230 | 13230 | Chl | oooooooooooo | 0mm00mm000000 | ACCGACUGGAAGA | 275 |
| CTGF-1230-13-13232 | 13232 | Chl | oooooooooooo | 0m0m0m00000m0 | AUGUACGGAGACA | 276 |
| CTGF-920-13-13234 | 13234 | Chl | oooooooooooo | 0mmmm0m0000mm | GCCUUGCGAAGCU | 277 |
| CTGF-679-13-13236 | 13236 | Chl | oooooooooooo | 0mm0m000000m0 | GCUGCGAGGAGUG | 278 |
| CTGF-992-13-13238 | 13238 | Chl | oooooooooooo | 0mmm0mm000mmm | GCCUAUCAAGUUU | 279 |
| CTGF-1045-13-13240 | 13240 | Chl | oooooooooooo | 00mmmm0m0000m | AAUUCUGUGGAGU | 280 |
| CTGF-1231-13-13242 | 13242 | Chl | oooooooooooo | m0m0m00000m0m | UGUACGGAGACAU | 281 |
| CTGF-991-13-13244 | 13244 | Chl | oooooooooooo | 00mmm0mm000mm | AGCCUAUCAAGUU | 282 |
| CTGF-998-13-13246 | 13246 | Chl | oooooooooooo | m000mmm000mmm | CAAGUUUGAGCUU | 283 |
| CTGF-1049-13-13248 | 13248 | Chl | oooooooooooo | mm0m0000m0m0m | CUGUGGAGUAUGU | 284 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-1044-13-13250 | 13250 | Chl | ooooooooooooo | ooommmmOmoooo | AAAUUCUGUGGAG | 285 |
| CTGF-1327-13-13252 | 13252 | Chl | ooooooooooooo | mmmmOOmOOmOmO | UUUCAGUAGCACA | 286 |
| CTGF-1196-13-13254 | 13254 | Chl | ooooooooooooo | mOOmOOmOmmmmm | CAAUGACAUCUUU | 287 |
| CTGF-562-13-13256 | 13256 | Chl | ooooooooooooo | OOmOmmOOmOmOm | AGUACCAGUGCAC | 288 |
| CTGF-752-13-13258 | 13258 | Chl | ooooooooooooo | oooooomOmOmmm | GGAAGACACGUUU | 289 |
| CTGF-994-13-13260 | 13260 | Chl | ooooooooooooo | mmOmmOOOmmmOO | CUAUCAAGUUUGA | 290 |
| CTGF-1040-13-13262 | 13262 | Chl | ooooooooooooo | OOmmOOOmmmmOm | AGCUAAAUUCUGU | 291 |
| CTGF-1984-13-13264 | 13264 | Chl | ooooooooooooo | ooomOOOOmOmOO | AGGUAGAAUGUAA | 292 |
| CTGF-2195-13-13266 | 13266 | Chl | ooooooooooooo | OOmmOOmmOOmmm | AGCUGAUCAGUUU | 293 |
| CTGF-2043-13-13268 | 13268 | Chl | ooooooooooooo | mmmmOmmmOOOmO | UUCUGCUCAGAUA | 294 |
| CTGF-1892-13-13270 | 13270 | Chl | ooooooooooooo | mmOmmmOOOmmOO | UUAUCUAAGUUAA | 295 |
| CTGF-1567-13-13272 | 13272 | Chl | ooooooooooooo | mOmOmOOOmOOmO | UAUACGAGUAAUA | 296 |
| CTGF-1780-13-13274 | 13274 | Chl | ooooooooooooo | OOmmOOOmOOmmm | GACUGGACAGCUU | 297 |
| CTGF-2162-13-13276 | 13276 | Chl | ooooooooooooo | OmOOmmmmmOmO | AUGGCCUUUAUUA | 298 |
| CTGF-1034-13-13278 | 13278 | Chl | ooooooooooooo | OmOmmOOOmmOOO | AUACCGAGCUAAA | 299 |
| CTGF-2264-13-13280 | 13280 | Chl | ooooooooooooo | mmOmmOOOOOmOm | UUGUUGAGAGUGU | 300 |
| CTGF-1032-13-13282 | 13282 | Chl | ooooooooooooo | OmOmOmmOOOmmO | ACAUACCGAGCUA | 301 |
| CTGF-1535-13-13284 | 13284 | Chl | ooooooooooooo | OOmOOOOOOOmmO | AGCAGAAAGGUUA | 302 |
| CTGF-1694-13-13286 | 13286 | Chl | ooooooooooooo | OOmmOmmmmmmOO | AGUUGUUCCUUAA | 303 |
| CTGF-1588-13-13288 | 13288 | Chl | ooooooooooooo | OmmmOOOOmOmOO | AUUUGAAGUGUAA | 304 |
| CTGF-928-13-13290 | 13290 | Chl | ooooooooooooo | ooommOOmmmOOO | AAGCUGACCUGGA | 305 |
| CTGF-1133-13-13292 | 13292 | Chl | ooooooooooooo | OOmmOmOOOOOOO | GGUCAUGAAGAAG | 306 |
| CTGF-912-13-13294 | 13294 | Chl | ooooooooooooo | OmOOmmOOOmmmm | AUGGUCAGGCCUU | 307 |
| CTGF-753-13-13296 | 13296 | Chl | ooooooooooooo | OOOOOmOmOmmmO | GAAGACACGUUUG | 308 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-918-13-13298 | 13298 | Chl | oooooooooooooo | oooommmmOmOooo | AGGCCUUGCGAAG | 309 |
| CTGF-744-13-13300 | 13300 | Chl | oooooooooooooo | mOmmOmmooooo | UACCGACUGGAAG | 310 |
| CTGF-466-13-13302 | 13302 | Chl | oooooooooooooo | OmmOmOoooommO | ACCGCAAGAUCGG | 311 |
| CTGF-917-13-13304 | 13304 | Chl | oooooooooooooo | mOooommmmOmOoo | CAGGCCUUGCGAA | 312 |
| CTGF-1038-13-13306 | 13306 | Chl | oooooooooooooo | mOooommOooommmm | CGAGCUAAAUUCU | 313 |
| CTGF-1048-13-13308 | 13308 | Chl | oooooooooooooo | mmmOmOoooOmOmO | UCUGUGGAGUAUG | 314 |
| CTGF-1235-13-13310 | 13310 | Chl | oooooooooooooo | mOooooOmOmOoOmO | CGGAGACAUGGCA | 315 |
| CTGF-868-13-13312 | 13312 | Chl | oooooooooooooo | OmOoOmOmOmmmm | AUGACAACGCCUC | 316 |
| CTGF-1131-13-13314 | 13314 | Chl | oooooooooooooo | ooooOmmOmOooooo | GAGGUCAUGAAGA | 317 |
| CTGF-1043-13-13316 | 13316 | Chl | oooooooooooooo | mOooommmmOmOoo | UAAAUUCUGUGGA | 318 |
| CTGF-751-13-13318 | 13318 | Chl | oooooooooooooo | mOoooooOmOmOmm | UGGAAGACACGUU | 319 |
| CTGF-1227-13-13320 | 13320 | Chl | oooooooooooooo | ooooOmOmOoooo | AAGAUGUACGGAG | 320 |
| CTGF-867-13-13322 | 13322 | Chl | oooooooooooooo | ooOmOoOmOmOmmm | AAUGACAACGCCU | 321 |
| CTGF-1128-13-13324 | 13324 | Chl | oooooooooooooo | ooOmooooOmmOmOoo | GGCGAGGUCAUGA | 322 |
| CTGF-756-13-13326 | 13326 | Chl | oooooooooooooo | ooOmOmOommmOomm | GACACGUUUGGCC | 323 |
| CTGF-1234-13-13328 | 13328 | Chl | oooooooooooooo | OmOooooOmOmOoOm | ACGGAGACAUGGC | 324 |
| CTGF-916-13-13330 | 13330 | Chl | oooooooooooooo | mmOooOmmmmOmOoo | UCAGGCCUUGCGA | 325 |
| CTGF-925-13-13332 | 13332 | Chl | oooooooooooooo | OmOoooOmmOoommm | GCGAAGCUGACCU | 326 |
| CTGF-1225-13-13334 | 13334 | Chl | oooooooooooooo | oooooOmOmOoOoo | GGAAGAUGUACGG | 327 |
| CTGF-445-13-13336 | 13336 | Chl | oooooooooooooo | OmOommmmOoommm | GUGACUUCGGCUC | 328 |
| CTGF-446-13-13338 | 13338 | Chl | oooooooooooooo | mOOmmmmOommmm | UGACUUCGGCUCC | 329 |
| CTGF-913-13-13340 | 13340 | Chl | oooooooooooooo | mOOmmOooommmmO | UGGUCAGGCCUUG | 330 |
| CTGF-997-13-13342 | 13342 | Chl | oooooooooooooo | mmOoommmOoommm | UCAAGUUUGAGCU | 331 |
| CTGF-277-13-13344 | 13344 | Chl | oooooooooooooo | OmmOooommOmOoo | GCCAGAACUGCAG | 332 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-1052-13-13346 | 13346 | Chl | oooooooooooo | m0000m0m0m0mm | UGGAGUAUGUACC | 333 |
| CTGF-887-13-13348 | 13348 | Chl | oooooooooooo | 0mm0000000m00 | GCUAGAGAAGCAG | 334 |
| CTGF-914-13-13350 | 13350 | Chl | oooooooooooo | 00mm000mmmm0m | GGUCAGGCCUUGC | 335 |
| CTGF-1039-13-13352 | 13352 | Chl | oooooooooooo | 000mm000mmmm0 | GAGCUAAAUUCUG | 336 |
| CTGF-754-13-13354 | 13354 | Chl | oooooooooooo | 0000m0m0mmm00 | AAGACACGUUUGG | 337 |
| CTGF-1130-13-13356 | 13356 | Chl | oooooooooooo | m0000mm0m0000 | CGAGGUCAUGAAG | 338 |
| CTGF-919-13-13358 | 13358 | Chl | oooooooooooo | 00mmmm0m0000m | GGCCUUGCGAAGC | 339 |
| CTGF-922-13-13360 | 13360 | Chl | oooooooooooo | mmm0m0000mm00 | CUUGCGAAGCUGA | 340 |
| CTGF-746-13-13362 | 13362 | Chl | oooooooooooo | mm00mm000000m | CCGACUGGAAGAC | 341 |
| CTGF-993-13-13364 | 13364 | Chl | oooooooooooo | mmm0m000mmm0 | CCUAUCAAGUUUG | 342 |
| CTGF-825-13-13366 | 13366 | Chl | oooooooooooo | m0mmmm0000mmm | UGUUCCAAGACCU | 343 |
| CTGF-926-13-13368 | 13368 | Chl | oooooooooooo | m0000mm00mmm0 | CGAAGCUGACCUG | 344 |
| CTGF-923-13-13370 | 13370 | Chl | oooooooooooo | mm0m0000mm00m | UUGCGAAGCUGAC | 345 |
| CTGF-866-13-13372 | 13372 | Chl | oooooooooooo | m00m0m00m0mm | CAAUGACAACGCC | 346 |
| CTGF-563-13-13374 | 13374 | Chl | oooooooooooo | 0mm0mm0m0m0m0 | GUACCAGUGCACG | 347 |
| CTGF-823-13-13376 | 13376 | Chl | oooooooooooo | mmm0mmmm0000m | CCUGUUCCAAGAC | 348 |
| CTGF-1233-13-13378 | 13378 | Chl | oooooooooooo | m0m00000m0m00 | UACGGAGACAUGG | 349 |
| CTGF-924-13-13380 | 13380 | Chl | oooooooooooo | m0m0000mm00mm | UGCGAAGCUGACC | 350 |
| CTGF-921-13-13382 | 13382 | Chl | oooooooooooo | mmmm0m0000mm0 | CCUUGCGAAGCUG | 351 |
| CTGF-443-13-13384 | 13384 | Chl | oooooooooooo | mm0m00mmmm00m | CUGUGACUUCGGC | 352 |
| CTGF-1041-13-13386 | 13386 | Chl | oooooooooooo | 0mm000mmmm0m0 | GCUAAAUUCUGUG | 353 |
| CTGF-1042-13-13388 | 13388 | Chl | oooooooooooo | mm000mmmm0m00 | CUAAAUUCUGUGG | 354 |
| CTGF-755-13-13390 | 13390 | Chl | oooooooooooo | 000m0m0mmm00m | AGACACGUUUGGC | 355 |
| CTGF-467-13-13392 | 13392 | Chl | oooooooooooo | mm0m0000mm00m | CCGCAAGAUCGGC | 356 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-995-13-13394 | 13394 | Chl | ooooooooooooo | m0mm000mmm000 | UAUCAAGUUUGAG | 357 |
| CTGF-927-13-13396 | 13396 | Chl | ooooooooooooo | 0000mm00mmm00 | GAAGCUGACCUGG | 358 |
| SPP1-1025-13-13398 | 13398 | Chl | ooooooooooooo | mmm0m000mm000 | CUCAUGAAUUAGA | 359 |
| SPP1-1049-13-13400 | 13400 | Chl | ooooooooooooo | mm0000mm00mm0 | CUGAGGUCAAUUA | 360 |
| SPP1-1051-13-13402 | 13402 | Chl | ooooooooooooo | 0000mm00mm000 | GAGGUCAAUUAAA | 361 |
| SPP1-1048-13-13404 | 13404 | Chl | ooooooooooooo | mmm0000mm00mm | UCUGAGGUCAAUU | 362 |
| SPP1-1050-13-13406 | 13406 | Chl | ooooooooooooo | m0000mm00mm00 | UGAGGUCAAUUAA | 363 |
| SPP1-1047-13-13408 | 13408 | Chl | ooooooooooooo | mmmm0000mm00m | UUCUGAGGUCAAU | 364 |
| SPP1-800-13-13410 | 13410 | Chl | ooooooooooooo | 0mm00mm000m00 | GUCAGCUGGAUGA | 365 |
| SPP1-492-13-13412 | 13412 | Chl | ooooooooooooo | mmmm00m000mmm | UUCUGAUGAAUCU | 366 |
| SPP1-612-13-13414 | 13414 | Chl | ooooooooooooo | m000mm0000mm0 | UGGACUGAGGUCA | 367 |
| SPP1-481-13-13416 | 13416 | Chl | ooooooooooooo | 000mmmm0mm0mm | GAGUCUCACCAUU | 368 |
| SPP1-614-13-13418 | 13418 | Chl | ooooooooooooo | 00mm0000mm000 | GACUGAGGUCAAA | 369 |
| SPP1-951-13-13420 | 13420 | Chl | ooooooooooooo | mm0m00mm0m000 | UCACAGCCAUGAA | 370 |
| SPP1-482-13-13422 | 13422 | Chl | ooooooooooooo | 00mmmm0m0mmm | AGUCUCACCAUUC | 371 |
| SPP1-856-13-13424 | 13424 | Chl | ooooooooooooo | 000m000000mm0 | AAGCGGAAAGCCA | 372 |
| SPP1-857-13-13426 | 13426 | Chl | ooooooooooooo | 00m000000mm00 | AGCGGAAAGCCAA | 373 |
| SPP1-365-13-13428 | 13428 | Chl | ooooooooooooo | 0mm0m0m000m00 | ACCACAUGGAUGA | 374 |
| SPP1-359-13-13430 | 13430 | Chl | ooooooooooooo | 0mm0m00mm0m0m | GCCAUGACCACAU | 375 |
| SPP1-357-13-13432 | 13432 | Chl | ooooooooooooo | 000mm0m00mm0m | AAGCCAUGACCAC | 376 |
| SPP1-858-13-13434 | 13434 | Chl | ooooooooooooo | 0m000000mm00m | GCGGAAAGCCAAU | 377 |
| SPP1-1012-13-13436 | 13436 | Chl | ooooooooooooo | 000mmmm0m0mmm | AAAUUCGUAUUU | 378 |
| SPP1-1014-13-13438 | 13438 | Chl | ooooooooooooo | 0mmmm0m0mmmmm | AUUUCGUAUUUCU | 379 |
| SPP1-356-13-13440 | 13440 | Chl | ooooooooooooo | 0000mm0m00mm0 | AAAGCCAUGACCA | 380 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| SPP1-368-13-13442 | 13442 | Chl | oooooooooooo | 0m0oo0m00m0m | ACAUGGAUGAUAU | 381 |
| SPP1-1011-13-13444 | 13444 | Chl | oooooooooooo | oooommmm0m0mm | GAAAUUUCGUAUU | 382 |
| SPP1-754-13-13446 | 13446 | Chl | oooooooooooo | 0m0mmmmmm00mm | GCGCCUUCUGAUU | 383 |
| SPP1-1021-13-13448 | 13448 | Chl | oooooooooooo | 0mmmmm0m000m | AUUUCUCAUGAAU | 384 |
| SPP1-1330-13-13450 | 13450 | Chl | oooooooooooo | mmmmm0m000m00 | CUCUCAUGAAUAG | 385 |
| SPP1-346-13-13452 | 13452 | Chl | oooooooooooo | 000mmm00m0000 | AAGUCCAACGAAA | 386 |
| SPP1-869-13-13454 | 13454 | Chl | oooooooooooo | 0m00m00000m00 | AUGAUGAGAGCAA | 387 |
| SPP1-701-13-13456 | 13456 | Chl | oooooooooooo | 0m000000mm000 | GCGAGGAGUUGAA | 388 |
| SPP1-896-13-13458 | 13458 | Chl | oooooooooooo | m00mm0m00mm0 | UGAUUGAUAGUCA | 389 |
| SPP1-1035-13-13460 | 13460 | Chl | oooooooooooo | 000m0m0m0mmm | AGAUAGUGCAUCU | 390 |
| SPP1-1170-13-13462 | 13462 | Chl | oooooooooooo | 0m0m0m0mmm0mm | AUGUGUAUCUAUU | 391 |
| SPP1-1282-13-13464 | 13464 | Chl | oooooooooooo | mmmm0m0000000 | UUCUAUAGAAGAA | 392 |
| SPP1-1537-13-13466 | 13466 | Chl | oooooooooooo | mm0mmm00m00mm | UUGUCCAGCAAUU | 393 |
| SPP1-692-13-13468 | 13468 | Chl | oooooooooooo | 0m0m000000m00 | ACAUGGAAAGCGA | 394 |
| SPP1-840-13-13470 | 13470 | Chl | oooooooooooo | 0m00mmm000mm0 | GCAGUCCAGAUUA | 395 |
| SPP1-1163-13-13472 | 13472 | Chl | oooooooooooo | m00mm000m0m0m | UGGUUGAAUGUGU | 396 |
| SPP1-789-13-13474 | 13474 | Chl | oooooooooooo | mm0m0000m000m | UUAUGAAACGAGU | 397 |
| SPP1-841-13-13476 | 13476 | Chl | oooooooooooo | m00mmm000mm0m | CAGUCCAGAUUAU | 398 |
| SPP1-852-13-13478 | 13478 | Chl | oooooooooooo | 0m0m000m00000 | AUAUAAGCGGAAA | 399 |
| SPP1-209-13-13480 | 13480 | Chl | oooooooooooo | m0mm00mm000m0 | UACCAGUUAAACA | 400 |
| SPP1-1276-13-13482 | 13482 | Chl | oooooooooooo | m0mmm0mmmm0m0 | UGUUCAUUCUAUA | 401 |
| SPP1-137-13-13484 | 13484 | Chl | oooooooooooo | mm00mm0000000 | CCGACCAAGGAAA | 402 |
| SPP1-711-13-13486 | 13486 | Chl | oooooooooooo | 000m0m0m0m0m | GAAUGGUGCAUAC | 403 |
| SPP1-582-13-13488 | 13488 | Chl | oooooooooooo | 0m0m00m00mm00 | AUAUGAUGGCCGA | 404 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| SPP1-839-13-13490 | 13490 | Chl | oooooooooooo | 00m00mmm000mm | AGCAGUCCAGAUU | 405 |
| SPP1-1091-13-13492 | 13492 | Chl | oooooooooooo | 0m0mmm00mm000 | GCAUUUAGUCAAA | 406 |
| SPP1-884-13-13494 | 13494 | Chl | oooooooooooo | 00m0mmmm00m0m | AGCAUUCCGAUGU | 407 |
| SPP1-903-13-13496 | 13496 | Chl | oooooooooooo | m00mm00000mmm | UAGUCAGGAACUU | 408 |
| SPP1-1090-13-13498 | 13498 | Chl | oooooooooooo | m0m0mmm00mm00 | UGCAUUUAGUCAA | 409 |
| SPP1-474-13-13500 | 13500 | Chl | oooooooooooo | 0mmm00m000mmm | GUCUGAUGAGUCU | 410 |
| SPP1-575-13-13502 | 13502 | Chl | oooooooooooo | m000m0m0m00 | UAGACACAUAUGA | 411 |
| SPP1-671-13-13504 | 13504 | Chl | oooooooooooo | m000m00000m0m | CAGACGAGGACAU | 412 |
| SPP1-924-13-13506 | 13506 | Chl | oooooooooooo | m00mm0m000mmm | CAGCCGUGAAUUC | 413 |
| SPP1-1185-13-13508 | 13508 | Chl | oooooooooooo | 00mmm00000m00 | AGUCUGGAAAUAA | 414 |
| SPP1-1221-13-13510 | 13510 | Chl | oooooooooooo | 00mmm0m00mmmm | AGUUUGUGGCUUC | 415 |
| SPP1-347-13-13512 | 13512 | Chl | oooooooooooo | 00mmm00m00000 | AGUCCAACGAAAG | 416 |
| SPP1-634-13-13514 | 13514 | Chl | oooooooooooo | 000mmmm0m000m | AAGUUUCGCAGAC | 417 |
| SPP1-877-13-13516 | 13516 | Chl | oooooooooooo | 00m00m000m0mm | AGCAAUGAGCAUU | 418 |
| SPP1-1033-13-13518 | 13518 | Chl | oooooooooooo | mm000m00m0m0m | UUAGAUAGUGCAU | 419 |
| SPP1-714-13-13520 | 13520 | Chl | oooooooooooo | m00m0m0m0m000 | UGGUGCAUACAAG | 420 |
| SPP1-791-13-13522 | 13522 | Chl | oooooooooooo | 0m0000m000mm0 | AUGAAACGAGUCA | 421 |
| SPP1-813-13-13524 | 13524 | Chl | oooooooooooo | mm0000m0mm000 | CCAGAGUGCUGAA | 422 |
| SPP1-939-13-13526 | 13526 | Chl | oooooooooooo | m00mm0m000mmm | CAGCCAUGAAUUU | 423 |
| SPP1-1161-13-13528 | 13528 | Chl | oooooooooooo | 0mm00mm000m0m | AUUGGUUGAAUGU | 424 |
| SPP1-1164-13-13530 | 13530 | Chl | oooooooooooo | 00mm000m0m0m0 | GGUUGAAUGUGUA | 425 |
| SPP1-1190-13-13532 | 13532 | Chl | oooooooooooo | 00000m00mm00m | GGAAAUAACUAAU | 426 |
| SPP1-1333-13-13534 | 13534 | Chl | oooooooooooo | mm0m000m00000 | UCAUGAAUAGAAA | 427 |
| SPP1-537-13-13536 | 13536 | Chl | oooooooooooo | 0mm0m00mm000 | GCCAGCAACCGAA | 428 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| SPP1-684-13-13538 | 13538 | Chl | oooooooooooo | m0mmmm0m0m0m0 | CACCUCACACAUG | 429 |
| SPP1-707-13-13540 | 13540 | Chl | oooooooooooo | 00mm000m00m0m | AGUUGAAUGGUGC | 430 |
| SPP1-799-13-13542 | 13542 | Chl | oooooooooooo | 00mm00mm000m0 | AGUCAGCUGGAUG | 431 |
| SPP1-853-13-13544 | 13544 | Chl | oooooooooooo | m0m000m000000 | UAUAAGCGGAAAG | 432 |
| SPP1-888-13-13546 | 13546 | Chl | oooooooooooo | mmmm00m0m00mm | UUCCGAUGUGAUU | 433 |
| SPP1-1194-13-13548 | 13548 | Chl | oooooooooooo | 0m00mm00m0m0m | AUAACUAAUGUGU | 434 |
| SPP1-1279-13-13550 | 13550 | Chl | oooooooooooo | mm0mmmm0m0000 | UCAUUCUAUAGAA | 435 |
| SPP1-1300-13-13552 | 13552 | Chl | oooooooooooo | 00mm0m0mm0m0 | AACUAUCACUGUA | 436 |
| SPP1-1510-13-13554 | 13554 | Chl | oooooooooooo | 0mm00mmmmm0m | GUCAAUUGCUUAU | 437 |
| SPP1-1543-13-13556 | 13556 | Chl | oooooooooooo | 00m00mm0m000 | AGCAAUUAAUAAA | 438 |
| SPP1-434-13-13558 | 13558 | Chl | oooooooooooo | 0m00mmmm00m00 | ACGACUCUGAUGA | 439 |
| SPP1-600-13-13560 | 13560 | Chl | oooooooooooo | m00m0m00mmm0m | UAGUGUGGUUUAU | 440 |
| SPP1-863-13-13562 | 13562 | Chl | oooooooooooo | 000mm00m00m00 | AAGCCAAUGAUGA | 441 |
| SPP1-902-13-13564 | 13564 | Chl | oooooooooooo | 0m00mm00000mm | AUAGUCAGGAACU | 442 |
| SPP1-921-13-13566 | 13566 | Chl | oooooooooooo | 00mm00mm0m000 | AGUCAGCCGUGAA | 443 |
| SPP1-154-13-13568 | 13568 | Chl | oooooooooooo | 0mm0m0m00000 | ACUACCAUGAGAA | 444 |
| SPP1-217-13-13570 | 13570 | Chl | oooooooooooo | 000m000mm00mm | AAACAGGCUGAUU | 445 |
| SPP1-816-13-13572 | 13572 | Chl | oooooooooooo | 000m0mm0000mm | GAGUGCUGAAACC | 446 |
| SPP1-882-13-13574 | 13574 | Chl | oooooooooooo | m000m0mmmm00m | UGAGCAUUCCGAU | 447 |
| SPP1-932-13-13576 | 13576 | Chl | oooooooooooo | 00mmmm0m00mm0 | AAUUCCACAGCCA | 448 |
| SPP1-1509-13-13578 | 13578 | Chl | oooooooooooo | m0mm00mm0mmm0 | UGUCAAUUGCUUA | 449 |
| SPP1-157-13-13580 | 13580 | Chl | oooooooooooo | 0mm0m00000mm0 | ACCAUGAGAAUUG | 450 |
| SPP1-350-13-13582 | 13582 | Chl | oooooooooooo | mm0m00000mm0 | CCAACGAAAGCCA | 451 |
| SPP1-511-13-13584 | 13584 | Chl | oooooooooooo | mm00mm0mm00mm | CUGGUCACUGAUU | 452 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| SPP1-605-13-13586 | 13586 | Chl | oooooooooooo | m00mmm0m000mm | UGGUUUAUGGACU | 453 |
| SPP1-811-13-13588 | 13588 | Chl | oooooooooooo | 00mm0000m0mm0 | GACCAGAGUGCUG | 454 |
| SPP1-892-13-13590 | 13590 | Chl | oooooooooooo | 00m0m00mm00m0 | GAUGUGAUUGAUA | 455 |
| SPP1-922-13-13592 | 13592 | Chl | oooooooooooo | 0mm00mm0m000m | GUCAGCCGUGAAU | 456 |
| SPP1-1169-13-13594 | 13594 | Chl | oooooooooooo | 00m0m0m0mmm0m | AAUGUGUAUCUAU | 457 |
| SPP1-1182-13-13596 | 13596 | Chl | oooooooooooo | mm000mmm00000 | UUGAGUCUGGAAA | 458 |
| SPP1-1539-13-13598 | 13598 | Chl | oooooooooooo | 0mmm00m00mm00 | GUCCAGCAAUUAA | 459 |
| SPP1-1541-13-13600 | 13600 | Chl | oooooooooooo | mm00m0mm00m0 | CCAGCAAUUAAUA | 460 |
| SPP1-427-13-13602 | 13602 | Chl | oooooooooooo | 00mmm000m00mm | GACUCGAACGACU | 461 |
| SPP1-533-13-13604 | 13604 | Chl | oooooooooooo | 0mmm0mm0m00m | ACCUGCCAGCAAC | 462 |
| APOB--13-13763 | 13763 | Chl TEG | oooooooooooo | 0m+00+m0+m0+m | ACtGAaUAcCAaU | 463 |
| APOB--13-13764 | 13764 | Chl TEG | oooooooooooo | 0mm000m0mm0m | ACUGAAUACCAAU | 464 |
| MAP4K4--16-13766 | 13766 | Chl | oooooooooooo | DY547mm0m00000mmm0 | CUGUGGAAGUCUA | 465 |
| PPIB--13-13767 | 13767 | Chl | oooooooooooo | mmmmmmmmmmmm | GGCUACAAAAACA | 466 |
| PPIB--15-13768 | 13768 | Chl | oooooooooooooo | mm00mm0m00000m0 | UUGGCUACAAAAACA | 467 |
| PPIB--17-13769 | 13769 | Chl | oooooooooooooooo | 0mmm00mm0m00000m0 | AUUUGGCUACAAAACA | 468 |
| MAP4K4--16-13939 | 13939 | Chl | oooooooooooo | m0m0000m0mmm0 | UGUAGGAUGUCUA | 469 |
| APOB-4314-16-13940 | 13940 | Chl | oooooooooooo | 0mmm0000000m0 | AUCUGGAGAAACA | 470 |
| APOB-4314-17-13941 | 13941 | Chl | oooooooooooooo | 000mmm0000000m0 | AGAUCUGGAGAAACA | 471 |
| APOB--16-13942 | 13942 | Chl | oooooooooooo | 00mmm0mmm0mm0 | GACUCAUCUGCUA | 472 |
| APOB--18-13943 | 13943 | Chl | oooooooooooo | 00mmm0mmm0mm0 | GACUCAUCUGCUA | 473 |
| APOB--17-13944 | 13944 | Chl | oooooooooooooo | m000mmm0mmm0mm0 | UGGACUCAUCUGCUA | 474 |
| APOB--19-13945 | 13945 | Chl | oooooooooooooo | m000mmm0mmm0mm0 | UGGACUCAUCUGCUA | 475 |
| APOB-4314-16-13946 | 13946 | Chl | oooooooooooo | 0000000m0m0m | GGAGAAACAACAU | 476 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| APOB-4314-17-13947 | 13947 | Chl | oooooooooooooo | mm0000000m00m0m | CUGGAGAAACAACAU | 477 |
| APOB--16-13948 | 13948 | Chl | oooooooooooo | 00mmmmmm000m0 | AGUCCCUCAAACA | 478 |
| APOB--17-13949 | 13949 | Chl | ooooooooooooo | 0000mmmmmm000m0 | AGAGUCCCUCAAACA | 479 |
| APOB--16-13950 | 13950 | Chl | oooooooooooo | 0mm000m0mm00m | ACUGAAUACCAAU | 480 |
| APOB--18-13951 | 13951 | Chl | oooooooooooo | 0mm000m0mm00m | ACUGAAUACCAAU | 481 |
| APOB--17-13952 | 13952 | Chl | ooooooooooooo | 0m0mm000m0mm00m | ACACUGAAUACCAAU | 482 |
| APOB--19-13953 | 13953 | Chl | ooooooooooooo | 0m0mm000m0mm00m | ACACUGAAUACCAAU | 483 |
| MAP4K4--16-13766.2 | 13766.2 | Chl | oooooooooooo | DY547mm0m00000mmm0 | CUGUGGAAGUCUA | 484 |
| CTGF-1222-16-13980 | 13980 | Chl | oooooooooooo | 0m0000000m0m0 | ACAGGAAGAUGUA | 485 |
| CTGF-813-16-13981 | 13981 | Chl | oooooooooooo | 000m0000mmmm | GAGUGGAGCGCCU | 486 |
| CTGF-747-16-13982 | 13982 | Chl | oooooooooooo | m0mm000000m0 | CGACUGGAAGACA | 487 |
| CTGF-817-16-13983 | 13983 | Chl | oooooooooooo | 0000mmmm0mmm | GGAGCGCCUGUUC | 488 |
| CTGF-1174-16-13984 | 13984 | Chl | oooooooooooo | 0mm0mm0m00mm0 | GCCAUUACAACUG | 489 |
| CTGF-1005-16-13985 | 13985 | Chl | oooooooooooo | 000mmmmmm00mm | GAGCUUUCUGGCU | 490 |
| CTGF-814-16-13986 | 13986 | Chl | oooooooooooo | 00m0000mmmm0 | AGUGGAGCGCCUG | 491 |
| CTGF-816-16-13987 | 13987 | Chl | oooooooooooo | m0000mmmm0mm | UGGAGCGCCUGUU | 492 |
| CTGF-1001-16-13988 | 13988 | Chl | oooooooooooo | 0mmm000mmmmmm | GUUUGAGCUUUCU | 493 |
| CTGF-1173-16-13989 | 13989 | Chl | oooooooooooo | m0mm0mm0m00mm | UGCCAUUACAACU | 494 |
| CTGF-749-16-13990 | 13990 | Chl | oooooooooooo | 0mm000000m0m | ACUGGAAGACACG | 495 |
| CTGF-792-16-13991 | 13991 | Chl | oooooooooooo | 00mm0mmm00mmm | AACUGCCUGGUCC | 496 |
| CTGF-1162-16-13992 | 13992 | Chl | oooooooooooo | 000mmm0m0mmm0 | AGACCUGUGCCUG | 497 |
| CTGF-811-16-13993 | 13993 | Chl | oooooooooooo | m0000m0000mm | CAGAGUGGAGCGC | 498 |
| CTGF-797-16-13994 | 13994 | Chl | oooooooooooo | mmm00mmm000mm | CCUGGUCCAGACC | 499 |
| CTGF-1175-16-13995 | 13995 | Chl | oooooooooooo | mm0mm0m00mm0m | CCAUUACAACUGU | 500 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-1172-16-13996 | 13996 | Chl | oooooooooooo | mm0mm0mm0m00m | CUGCCAUUACAAC | 501 |
| CTGF-1177-16-13997 | 13997 | Chl | oooooooooooo | 0mm0m00mm0mmm | AUUACAACUGUCC | 502 |
| CTGF-1176-16-13998 | 13998 | Chl | oooooooooooo | m0mm0m00mm0mm | CAUUACAACUGUC | 503 |
| CTGF-812-16-13999 | 13999 | Chl | oooooooooooo | 0000m0000mmm | AGAGUGGAGCGCC | 504 |
| CTGF-745-16-14000 | 14000 | Chl | oooooooooooo | 0mm0mm000000 | ACCGACUGGAAGA | 505 |
| CTGF-1230-16-14001 | 14001 | Chl | oooooooooooo | 0m0m00000m0 | AUGUACGGAGACA | 506 |
| CTGF-920-16-14002 | 14002 | Chl | oooooooooooo | 0mmmm0m000mm | GCCUUGCGAAGCU | 507 |
| CTGF-679-16-14003 | 14003 | Chl | oooooooooooo | 0mm0m00000m0 | GCUGCGAGGAGUG | 508 |
| CTGF-992-16-14004 | 14004 | Chl | oooooooooooo | 0mmm0m000mmm | GCCUAUCAAGUUU | 509 |
| CTGF-1045-16-14005 | 14005 | Chl | oooooooooooo | 00mmmm0m0000m | AAUUCUGUGGAGU | 510 |
| CTGF-1231-16-14006 | 14006 | Chl | oooooooooooo | m0m0m0000m0m | UGUACGGAGACAU | 511 |
| CTGF-991-16-14007 | 14007 | Chl | oooooooooooo | 00mmm0mm000mm | AGCCUAUCAAGUU | 512 |
| CTGF-998-16-14008 | 14008 | Chl | oooooooooooo | m000mmm000mmm | CAAGUUUGAGCUU | 513 |
| CTGF-1049-16-14009 | 14009 | Chl | oooooooooooo | mm0m0000m0m0m | CUGUGGAGUAUGU | 514 |
| CTGF-1044-16-14010 | 14010 | Chl | oooooooooooo | 000mmmm0m0000 | AAAUUCUGUGGAG | 515 |
| CTGF-1327-16-14011 | 14011 | Chl | oooooooooooo | mmmm00m00m0m0 | UUUCAGUAGCACA | 516 |
| CTGF-1196-16-14012 | 14012 | Chl | oooooooooooo | m00m00m0mmmmm | CAAUGACAUCUUU | 517 |
| CTGF-562-16-14013 | 14013 | Chl | oooooooooooo | 00m0mm00m0m0m | AGUACCAGUGCAC | 518 |
| CTGF-752-16-14014 | 14014 | Chl | oooooooooooo | 000000m0mmmm | GGAAGACACGUUU | 519 |
| CTGF-994-16-14015 | 14015 | Chl | oooooooooooo | mm0mm000mmm00 | CUAUCAAGUUUGA | 520 |
| CTGF-1040-16-14016 | 14016 | Chl | oooooooooooo | 00mm000mmmm0m | AGCUAAAUUCUGU | 521 |
| CTGF-1984-16-14017 | 14017 | Chl | oooooooooooo | 000m0000m0m00 | AGGUAGAAUGUAA | 522 |
| CTGF-2195-16-14018 | 14018 | Chl | oooooooooooo | 00m00mm00mmm | AGCUGAUCAGUUU | 523 |
| CTGF-2043-16-14019 | 14019 | Chl | oooooooooooo | mmmm0mmm000m0 | UUCUGCUCAGAUA | 524 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-1892-16-14020 | 14020 | Chl | oooooooooooo | mm0mmm000mm00 | UUAUCUAAGUUAA | 525 |
| CTGF-1567-16-14021 | 14021 | Chl | oooooooooooo | m0m0m00m00m0 | UAUACGAGUAAUA | 526 |
| CTGF-1780-16-14022 | 14022 | Chl | oooooooooooo | 00mm000m00mmm | GACUGGACAGCUU | 527 |
| CTGF-2162-16-14023 | 14023 | Chl | oooooooooooo | 0m00mmmmm0mm0 | AUGGCCUUUAUUA | 528 |
| CTGF-1034-16-14024 | 14024 | Chl | oooooooooooo | 0m0mm0mm000 | AUACCGAGCUAAA | 529 |
| CTGF-2264-16-14025 | 14025 | Chl | oooooooooooo | mm0mm00000m0m | UUGUUGAGAGUGU | 530 |
| CTGF-1032-16-14026 | 14026 | Chl | oooooooooooo | 0m0m0mm00mm0 | ACAUACCGAGCUA | 531 |
| CTGF-1535-16-14027 | 14027 | Chl | oooooooooooo | 00m0000000mm0 | AGCAGAAAGGUUA | 532 |
| CTGF-1694-16-14028 | 14028 | Chl | oooooooooooo | 00mm0mmmmmm00 | AGUUGUUCCUUAA | 533 |
| CTGF-1588-16-14029 | 14029 | Chl | oooooooooooo | 0mmm0000m0m00 | AUUUGAAGUGUAA | 534 |
| CTGF-928-16-14030 | 14030 | Chl | oooooooooooo | 000mm00mmm000 | AAGCUGACCUGGA | 535 |
| CTGF-1133-16-14031 | 14031 | Chl | oooooooooooo | 00mm0m0000000 | GGUCAUGAAGAAG | 536 |
| CTGF-912-16-14032 | 14032 | Chl | oooooooooooo | 0m00mm000mmmm | AUGGUCAGGCCUU | 537 |
| CTGF-753-16-14033 | 14033 | Chl | oooooooooooo | 00000m0mmmm0 | GAAGACACGUUUG | 538 |
| CTGF-918-16-14034 | 14034 | Chl | oooooooooooo | 000mmmm0m000 | AGGCCUUGCGAAG | 539 |
| CTGF-744-16-14035 | 14035 | Chl | oooooooooooo | m0mm0mm00000 | UACCGACUGGAAG | 540 |
| CTGF-466-16-14036 | 14036 | Chl | oooooooooooo | 0mmm0000mm0 | ACCGCAAGAUCGG | 541 |
| CTGF-917-16-14037 | 14037 | Chl | oooooooooooo | m000mmmm0m00 | CAGGCCUUGCGAA | 542 |
| CTGF-1038-16-14038 | 14038 | Chl | oooooooooooo | m00mm000mmmm | CGAGCUAAAUUCU | 543 |
| CTGF-1048-16-14039 | 14039 | Chl | oooooooooooo | mmm0m0000m0m0 | UCUGUGGAGUAUG | 544 |
| CTGF-1235-16-14040 | 14040 | Chl | oooooooooooo | m0000m0m00m0 | CGGAGACAUGGCA | 545 |
| CTGF-868-16-14041 | 14041 | Chl | oooooooooooo | 0m00m0mmmmm | AUGACAACGCCUC | 546 |
| CTGF-1131-16-14042 | 14042 | Chl | oooooooooooo | 0000mm0m00000 | GAGGUCAUGAAGA | 547 |
| CTGF-1043-16-14043 | 14043 | Chl | oooooooooooo | m000mmmm0m000 | UAAAUUCUGUGGA | 548 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-751-16-14044 | 14044 | Chl | oooooooooooo | m0000o0m0mmm | UGGAAGACACGUU | 549 |
| CTGF-1227-16-14045 | 14045 | Chl | oooooooooooo | 0000m0m0m000 | AAGAUGUACGGAG | 550 |
| CTGF-867-16-14046 | 14046 | Chl | oooooooooooo | 00m00o00mmmm | AAUGACAACGCCU | 551 |
| CTGF-1128-16-14047 | 14047 | Chl | oooooooooooo | 00m000mm0m00 | GGCGAGGUCAUGA | 552 |
| CTGF-756-16-14048 | 14048 | Chl | oooooooooooo | 00m0m0mmm00mm | GACACGUUUGGCC | 553 |
| CTGF-1234-16-14049 | 14049 | Chl | oooooooooooo | 0m00000m0m00m | ACGGAGACAUGGC | 554 |
| CTGF-916-16-14050 | 14050 | Chl | oooooooooooo | mm000mmmm0m00 | UCAGGCCUUGCGA | 555 |
| CTGF-925-16-14051 | 14051 | Chl | oooooooooooo | 0m0000mm00mmm | GCGAAGCUGACCU | 556 |
| CTGF-1225-16-14052 | 14052 | Chl | oooooooooooo | 000000m0m0m00 | GGAAGAUGUACGG | 557 |
| CTGF-445-16-14053 | 14053 | Chl | oooooooooooo | 0m00mmmm00mmm | GUGACUUCGGCUC | 558 |
| CTGF-446-16-14054 | 14054 | Chl | oooooooooooo | m00mmmm00mmmm | UGACUUCGGCUCC | 559 |
| CTGF-913-16-14055 | 14055 | Chl | oooooooooooo | m00mm000mmmm0 | UGGUCAGGCCUUG | 560 |
| CTGF-997-16-14056 | 14056 | Chl | oooooooooooo | mm000mmm000mm | UCAAGUUUGAGCU | 561 |
| CTGF-277-16-14057 | 14057 | Chl | oooooooooooo | 0mm0000mm0m00 | GCCAGAACUGCAG | 562 |
| CTGF-1052-16-14058 | 14058 | Chl | oooooooooooo | m0000m0m0m0mm | UGGAGUAUGUACC | 563 |
| CTGF-887-16-14059 | 14059 | Chl | oooooooooooo | 0mm0000000m00 | GCUAGAGAAGCAG | 564 |
| CTGF-914-16-14060 | 14060 | Chl | oooooooooooo | 00mm000mmmm0m | GGUCAGGCCUUGC | 565 |
| CTGF-1039-16-14061 | 14061 | Chl | oooooooooooo | 000mm000mmmm0 | GAGCUAAAUUCUG | 566 |
| CTGF-754-16-14062 | 14062 | Chl | oooooooooooo | 0000m0m0mmm00 | AAGACACGUUUGG | 567 |
| CTGF-1130-16-14063 | 14063 | Chl | oooooooooooo | m0000mm0m0000 | CGAGGUCAUGAAG | 568 |
| CTGF-919-16-14064 | 14064 | Chl | oooooooooooo | 00mmmm0m0000m | GGCCUUGCGAAGC | 569 |
| CTGF-922-16-14065 | 14065 | Chl | oooooooooooo | mmm0m0000mm00 | CUUGCGAAGCUGA | 570 |
| CTGF-746-16-14066 | 14066 | Chl | oooooooooooo | mm00mm000000m | CCGACUGGAAGAC | 571 |
| CTGF-993-16-14067 | 14067 | Chl | oooooooooooo | mmm0mm000mmm0 | CCUAUCAAGUUUG | 572 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| CTGF-825-16-14068 | 14068 | Chl | oooooooooooo | m0mmmm0000mmm | UGUUCCAAGACCU | 573 |
| CTGF-926-16-14069 | 14069 | Chl | oooooooooooo | m0000mm00mmm0 | CGAAGCUGACCUG | 574 |
| CTGF-923-16-14070 | 14070 | Chl | oooooooooooo | mm0m0000mm00m | UUGCGAAGCUGAC | 575 |
| CTGF-866-16-14071 | 14071 | Chl | oooooooooooo | m00m00m0m0mm | CAAUGACAACGCC | 576 |
| CTGF-563-16-14072 | 14072 | Chl | oooooooooooo | 0m0mm00m0m0m0 | GUACCAGUGCACG | 577 |
| CTGF-823-16-14073 | 14073 | Chl | oooooooooooo | mmm0mmmm0000m | CCUGUUCCAAGAC | 578 |
| CTGF-1233-16-14074 | 14074 | Chl | oooooooooooo | m0m00000m0m00 | UACGGAGACAUGG | 579 |
| CTGF-924-16-14075 | 14075 | Chl | oooooooooooo | m0m0000mm00mm | UGCGAAGCUGACC | 580 |
| CTGF-921-16-14076 | 14076 | Chl | oooooooooooo | mmmm0m0000mm0 | CCUUGCGAAGCUG | 581 |
| CTGF-443-16-14077 | 14077 | Chl | oooooooooooo | mm0m00mmmm00m | CUGUGACUUCGGC | 582 |
| CTGF-1041-16-14078 | 14078 | Chl | oooooooooooo | 0mm000mmmm0m0 | GCUAAAUUCUGUG | 583 |
| CTGF-1042-16-14079 | 14079 | Chl | oooooooooooo | mm000mmmm0m00 | CUAAAUUCUGUGG | 584 |
| CTGF-755-16-14080 | 14080 | Chl | oooooooooooo | 000m0m0mmm0m | AGACACGUUUGGC | 585 |
| CTGF-467-16-14081 | 14081 | Chl | oooooooooooo | mm0m0000mm00m | CCGCAAGAUCGGC | 586 |
| CTGF-995-16-14082 | 14082 | Chl | oooooooooooo | m0mm000mmm000 | UAUCAAGUUUGAG | 587 |
| CTGF-927-16-14083 | 14083 | Chl | oooooooooooo | 0000mm00mmm00 | GAAGCUGACCUGG | 588 |
| SPP1-1091-16-14131 | 14131 | Chl | oooooooooooo | 0m0mmm00mm000 | GCAUUUAGUCAAA | 589 |
| PPIB--16-14188 | 14188 | Chl | oooooooooooo | mmmmmmmmmmmm | GGCUACAAAACA | 590 |
| PPIB--17-14189 | 14189 | Chl | oooooooooooooo | mm00mm0m00000m0 | UUGGCUACAAAACA | 591 |
| PPIB--18-14190 | 14190 | Chl | oooooooooooooooo | 0mmm00mm0m00000m0 | AUUUGGCUACAAAAACA | 592 |
| pGL3-1172-16-14386 | 14386 | Chl | oooooooooooo | 0m000m00mmm | ACAAAUACGAUUU | 593 |
| pGL3-1172-16-14387 | 14387 | Chl | oooooooooooo | DY5470m000m0m00mmm | ACAAAUACGAUUU | 594 |
| MAP4K4-2931-25-14390 | 14390 | Chl | oooooooooooooooooooooooooo | Pmmmmmmmmmmmm000mmmmmmmmm | CUUUGAAGAGUUCUGUGGAAGUCUA | 595 |
| miR-122--23-14391 | 14391 | Chl | ssooooooooooooooooossss | mmmmmmmmmmmmmmmmmmmmmmmmm | ACAAACACCAUUGUCACACUCCA | 596 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| | 14084 | Chl | oooooooooooooo | mmm0m000mm000 | CUCAUGAAUUAGA | 719 |
| | 14085 | Chl | oooooooooooooo | mm0000mm00mm0 | CUGAGGUCAAUUA | 720 |
| | 14086 | Chl | oooooooooooooo | 0000mm00mm000 | GAGGUCAAUUAAA | 721 |
| | 14087 | Chl | oooooooooooooo | mmm0000mm00mm | UCUGAGGUCAAUU | 722 |
| | 14088 | Chl | oooooooooooooo | m0000mm00mm00 | UGAGGUCAAUUAA | 723 |
| | 14089 | Chl | oooooooooooooo | mmmm0000mm00m | UUCUGAGGUCAAU | 724 |
| | 14090 | Chl | oooooooooooooo | 0mm00mm000m00 | GUCAGCUGGAUGA | 725 |
| | 14091 | Chl | oooooooooooooo | mmmm00m000mmm | UUCUGAUGAAUCU | 726 |
| | 14092 | Chl | oooooooooooooo | m000mm0000mm0 | UGGACUGAGGUCA | 727 |
| | 14093 | Chl | oooooooooooooo | 000mmmm0mm0mm | GAGUCUCACCAUU | 728 |
| | 14094 | Chl | oooooooooooooo | 00mm0000mm000 | GACUGAGGUCAAA | 729 |
| | 14095 | Chl | oooooooooooooo | mm0m00mm0m000 | UCACAGCCAUGAA | 730 |
| | 14096 | Chl | oooooooooooooo | 00mmmm0mm0mmm | AGUCUCACCAUUC | 731 |
| | 14097 | Chl | oooooooooooooo | 000m00000mm0 | AAGCGGAAAGCCA | 732 |
| | 14098 | Chl | oooooooooooooo | 00m00000mm00 | AGCGGAAAGCCAA | 733 |
| | 14099 | Chl | oooooooooooooo | 0mm0m0m000m00 | ACCACAUGGAUGA | 734 |
| | 14100 | Chl | oooooooooooooo | 0mm0m00mm0m0m | GCCAUGACCACAU | 735 |
| | 14101 | Chl | oooooooooooooo | 000mm0m00mm0m | AAGCCAUGACCAC | 736 |
| | 14102 | Chl | oooooooooooooo | 0m00000mm00m | GCGGAAAGCCAAU | 737 |
| | 14103 | Chl | oooooooooooooo | 000mmmmm0mmm | AAAUUUCGUAUUU | 738 |
| | 14104 | Chl | oooooooooooooo | 0mmmmm0mmmmm | AUUUCGUAUUUCU | 739 |
| | 14105 | Chl | oooooooooooooo | 0000mm0m00mm0 | AAAGCCAUGACCA | 740 |
| | 14106 | Chl | oooooooooooooo | 0m0m00m0m00m0m | ACAUGGAUGAUAU | 741 |
| | 14107 | Chl | oooooooooooooo | 0000mmmmm0mm | GAAAUUUCGUAUU | 742 |
| | 14108 | Chl | oooooooooooooo | 0mmmmmmm00mm | GCGCCUUCUGAUU | 743 |
| | 14109 | Chl | oooooooooooooo | 0mmmmmm0m000m | AUUUCUCAUGAAU | 744 |
| | 14110 | Chl | oooooooooooooo | mmmmm0m000m00 | CUCUCAUGAAUAG | 745 |
| | 14111 | Chl | oooooooooooooo | 000mmm00m000 | AAGUCCAACGAAA | 746 |
| | 14112 | Chl | oooooooooooooo | 0m00m00000m00 | AUGAUGAGAGCAA | 747 |
| | 14113 | Chl | oooooooooooooo | 0m00000mm000 | GCGAGGAGUUGAA | 748 |
| | 14114 | Chl | oooooooooooooo | m00mm0m00mm0 | UGAUUGAUAGUCA | 749 |
| | 14115 | Chl | oooooooooooooo | 000m00m0m0mmm | AGAUAGUGCAUCU | 750 |
| | 14116 | Chl | oooooooooooooo | 0m0m0m0mmm0mm | AUGUGUAUCUAUU | 751 |
| | 14117 | Chl | oooooooooooooo | mmmm0m0000000 | UUCUAUAGAAGAA | 752 |
| | 14118 | Chl | oooooooooooooo | mm0mmm00m0mm | UUGUCCAGCAAUU | 753 |
| | 14119 | Chl | oooooooooooooo | 0m0m000000m0 | ACAUGGAAAGCGA | 754 |
| | 14120 | Chl | oooooooooooooo | 0m00mmm000mm0 | GCAGUCCAGAUUA | 755 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| | 14121 | Chl | oooooooooooo | m00mm000m0m0m | UGGUUGAAUGUGU | 756 |
| | 14122 | Chl | oooooooooooo | mm0m0000m00m | UUAUGAAACGAGU | 757 |
| | 14123 | Chl | oooooooooooo | m00mmm000mm0m | CAGUCCAGAUUAU | 758 |
| | 14124 | Chl | oooooooooooo | 0m0m000m0000 | AUAUAAGCGGAAA | 759 |
| | 14125 | Chl | oooooooooooo | m0mm00mm000m0 | UACCAGUUAAACA | 760 |
| | 14126 | Chl | oooooooooooo | m0mmm0mmmm0m0 | UGUUCAUUCUAUA | 761 |
| | 14127 | Chl | oooooooooooo | mm0mm0000000 | CCGACCAAGGAAA | 762 |
| | 14128 | Chl | oooooooooooo | 000m00m0m0m0m | GAAUGGUGCAUAC | 763 |
| | 14129 | Chl | oooooooooooo | 0m0m00m00mm0 | AUAUGAUGGCCGA | 764 |
| | 14130 | Chl | oooooooooooo | 00m00mmm000mm | AGCAGUCCAGAUU | 765 |
| | 14132 | Chl | oooooooooooo | 00m0mmmm0m0m | AGCAUUCCGAUGU | 766 |
| | 14133 | Chl | oooooooooooo | m00mm0000mmm | UAGUCAGGAACUU | 767 |
| | 14134 | Chl | oooooooooooo | m0m0mmm00mm00 | UGCAUUUAGUCAA | 768 |
| | 14135 | Chl | oooooooooooo | 0mmm00m000mmm | GUCUGAUGAGUCU | 769 |
| | 14136 | Chl | oooooooooooo | m000m0m0m0m00 | UAGACACAUAUGA | 770 |
| | 14137 | Chl | oooooooooooo | m000m0000m0m | CAGACGAGGACAU | 771 |
| | 14138 | Chl | oooooooooooo | m00mmm000mmm | CAGCCGUGAAUUC | 772 |
| | 14139 | Chl | oooooooooooo | 00mmm00000m00 | AGUCUGGAAAUAA | 773 |
| | 14140 | Chl | oooooooooooo | 00mmm0m00mmmm | AGUUUGUGGCUUC | 774 |
| | 14141 | Chl | oooooooooooo | 00mmm00m0000 | AGUCCAACGAAAG | 775 |
| | 14142 | Chl | oooooooooooo | 000mmmmmm000m | AAGUUUCGCAGAC | 776 |
| | 14143 | Chl | oooooooooooo | 00m00m000m0mm | AGCAAUGAGCAUU | 777 |
| | 14144 | Chl | oooooooooooo | mm000m00m0m0m | UUAGAUAGUGCAU | 778 |
| | 14145 | Chl | oooooooooooo | m00m0m0m0m000 | UGGUGCAUACAAG | 779 |
| | 14146 | Chl | oooooooooooo | 0m0000m00mm0 | AUGAAACGAGUCA | 780 |
| | 14147 | Chl | oooooooooooo | mm0000m0mm000 | CCAGAGUGCUGAA | 781 |
| | 14148 | Chl | oooooooooooo | m00mm0m000mmm | CAGCCAUGAAUUU | 782 |
| | 14149 | Chl | oooooooooooo | 0mm00mm000m0m | AUUGGUUGAAUGU | 783 |
| | 14150 | Chl | oooooooooooo | 00mm000m0m0m0 | GGUUGAAUGUGUA | 784 |
| | 14151 | Chl | oooooooooooo | 00000m00mm0m | GGAAUAACUAAU | 785 |
| | 14152 | Chl | oooooooooooo | mm000m00000 | UCAUGAAUAGAAA | 786 |
| | 14153 | Chl | oooooooooooo | 0mm0m00mm00 | GCCAGCAACCGAA | 787 |
| | 14154 | Chl | oooooooooooo | m0mmmm0m0m0m0 | CACCUCACACAUG | 788 |
| | 14155 | Chl | oooooooooooo | 00mm000m00m0m | AGUUGAAUGGUGC | 789 |
| | 14156 | Chl | oooooooooooo | 00m00mm000m0 | AGUCAGCUGGAUG | 790 |
| | 14157 | Chl | oooooooooooo | m0m000m00000 | UAUAAGCGGAAAG | 791 |
| | 14158 | Chl | oooooooooooo | mmmm0m0m00mm | UUCCGAUGUGAUU | 792 |

TABLE 3-continued

Sense backbone, chemistry, and sequence information.

| ID Number | Oligo Number | OHang Sense Chem. | Sense Backbone | Sense Chemistry | Sense Sequence | SEQ ID NO: |
|---|---|---|---|---|---|---|
| | 14159 | Chl | oooooooooooo | 0m00mm00m0m0m | AUAACUAAUGUGU | 793 |
| | 14160 | Chl | oooooooooooo | mm0mmmm0m0000 | UCAUUCUAUAGAA | 794 |
| | 14161 | Chl | oooooooooooo | 00mm0mm0mm0m0 | AACUAUCACUGUA | 795 |
| | 14162 | Chl | oooooooooooo | 0mm00mm0mmm0m | GUCAAUUGCUUAU | 796 |
| | 14163 | Chl | oooooooooooo | 00m00mm00m000 | AGCAAUUAAUAAA | 797 |
| | 14164 | Chl | oooooooooooo | 0m0mmmm00m00 | ACGACUCUGAUGA | 798 |
| | 14165 | Chl | oooooooooooo | m00m0m00mmm0m | UAGUGUGGUUUAU | 799 |
| | 14166 | Chl | oooooooooooo | 000mm00m00m00 | AAGCCAAUGAUGA | 800 |
| | 14167 | Chl | oooooooooooo | 0m00mm00000mm | AUAGUCAGGAACU | 801 |
| | 14168 | Chl | oooooooooooo | 00mm00mmm000 | AGUCAGCCGUGAA | 802 |
| | 14169 | Chl | oooooooooooo | 0mm0mm0m00000 | ACUACCAUGAGAA | 803 |
| | 14170 | Chl | oooooooooooo | 000m000mm00mm | AAACAGGCUGAUU | 804 |
| | 14171 | Chl | oooooooooooo | 000m0mm0000mm | GAGUGCUGAAACC | 805 |
| | 14172 | Chl | oooooooooooo | m000m0mmmm0m | UGAGCAUUCCGAU | 806 |
| | 14173 | Chl | oooooooooooo | 00mmmm0m00mm0 | AAUUCCACAGCCA | 807 |
| | 14174 | Chl | oooooooooooo | m0mm00mm0mmm0 | UGUCAAUUGCUUA | 808 |
| | 14175 | Chl | oooooooooooo | 0mm0m00000mm0 | ACCAUGAGAAUUG | 809 |
| | 14176 | Chl | oooooooooooo | mm00m0000mm0 | CCAACGAAAGCCA | 810 |
| | 14177 | Chl | oooooooooooo | mm00mm0m00mm | CUGGUCACUGAUU | 811 |
| | 14178 | Chl | oooooooooooo | m00mmm0m000mm | UGGUUUAUGGACU | 812 |
| | 14179 | Chl | oooooooooooo | 00mm0000m0mm0 | GACCAGAGUGCUG | 813 |
| | 14180 | Chl | oooooooooooo | 00m0m00mm00m0 | GAUGUGAUUGAUA | 814 |
| | 14181 | Chl | oooooooooooo | 0mm00mmm000m | GUCAGCCGUGAAU | 815 |
| | 14182 | Chl | oooooooooooo | 00m0m0m0mmm0m | AAUGUGUAUCUAU | 816 |
| | 14183 | Chl | oooooooooooo | mm000mmm00000 | UUGAGUCUGGAAA | 817 |
| | 14184 | Chl | oooooooooooo | 0mmm00m0mm00 | GUCCAGCAAUUAA | 818 |
| | 14185 | Chl | oooooooooooo | mm00m00mm0m0 | CCAGCAAUUAAUA | 819 |
| | 14186 | Chl | oooooooooooo | 00mmm00m0mm | GACUCGAACGACU | 820 |
| | 14187 | Chl | oooooooooooo | 0mmm0mm00m00m | ACCUGCCAGCAAC | 821 | o: phosphodiester;
s: phosphorothioate;
P: 5' phosphorylation;
O: 2'-OH;
F: 2'-fluoro;
m: 2' O-methyl;
+: LNA modification.
Capital letters in the sequence signify ribonucleotides,
lower case letters signify deoxyribonucleotides.

TABLE 4 sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-let-7a MIMAT0000062 | 822 | UGAGGUAGUAGGUUGUAUAGUU | 823 | UGAGGUAGUAGGUUGUAUAG | 824 | AACCUACUACCUCA |
| hsa-let-7a* MIMAT0004481 | 825 | CUAUACAAUCUACUGUCUUUC | 826 | CUAUACAAUCUACUGUCUUU | 827 | AGUAGAUUGUAUAG |
| hsa-let-7a-2* MIMAT0010195 | 828 | CUGUACAGCCUCCUAGCUUUCC | 829 | CUGUACAGCCUCCUAGCUUU | 830 | AGGAGGCUGUACAG |
| hsa-let-7b MIMAT0000063 | 831 | UGAGGUAGUAGGUUGUGUGGUU | 832 | UGAGGUAGUAGGUUGUGUGG | 833 | AACCUACUACCUCA |
| hsa-let-7b* MIMAT0004482 | 834 | CUAUACAACCUACUGCCUUCCC | 835 | CUAUACAACCUACUGCCUUC | 836 | AGUAGGUUGUAUAG |
| hsa-let-7c MIMAT0000064 | 837 | UGAGGUAGUAGGUUGUAUGGUU | 838 | UGAGGUAGUAGGUUGUAUGG | 839 | AACCUACUACCUCA |
| hsa-let-7c* MIMAT0004483 | 840 | UAGAGUUACACCCUGGGAGUUA | 841 | UAGAGUUACACCCUGGGAGU | 842 | AGGGUGUAACUCUA |
| hsa-let-7d MIMAT0000065 | 843 | AGAGGUAGUAGGUUGCAUAGUU | 844 | AGAGGUAGUAGGUUGCAUAG | 845 | AACCUACUACCUCU |
| hsa-let-7d* MIMAT0004484 | 846 | CUAUACGACCUGCUGCCUUUCU | 847 | CUAUACGACCUGCUGCCUUU | 848 | AGCAGGUCGUAUAG |
| hsa-let-7e MIMAT0000066 | 849 | UGAGGUAGGAGGUUGUAUAGUU | 850 | UGAGGUAGGAGGUUGUAUAG | 851 | AACCUCCUACCUCA |
| hsa-let-7e* MIMAT0004485 | 852 | CUAUACGGCCUCCUAGCUUUCC | 853 | CUAUACGGCCUCCUAGCUUU | 854 | AGGAGGCCGUAUAG |
| hsa-let-7f MIMAT0000067 | 855 | UGAGGUAGUAGAUUGUAUAGUU | 856 | UGAGGUAGUAGAUUGUAUAG | 857 | AAUCUACUACCUCA |
| hsa-let-7f-1* MIMAT0004486 | 858 | CUAUACAAUCUAUUGCCUUCCC | 859 | CUAUACAAUCUAUUGCCUUC | 860 | AAUAGAUUGUAUAG |
| hsa-let-7f-2* MIMAT0004487 | 861 | CUAUACAGUCUACUGUCUUUCC | 862 | CUAUACAGUCUACUGUCUUU | 863 | AGUAGACUGUAUAG |
| hsa-let-7g MIMAT0000414 | 864 | UGAGGUAGUAGUUUGUACAGUU | 865 | UGAGGUAGUAGUUUGUACAG | 866 | AAACUACUACCUCA |
| hsa-let-7g* MIMAT0004584 | 867 | CUGUACAGGCCACUGCCUUGC | 868 | CUGUACAGGCCACUGCCUUG | 869 | AGUGGCCUGUACAG |
| hsa-let-7i MIMAT0000415 | 870 | UGAGGUAGUAGUUUGUGCUGUU | 871 | UGAGGUAGUAGUUUGUGCUG | 872 | AAACUACUACCUCA |
| hsa-let-7i* MIMAT0004585 | 873 | CUGCGCAAGCUACUGCCUUGCU | 874 | CUGCGCAAGCUACUGCCUUG | 875 | AGUAGCUUGCGCAG |
| hsa-miR-1 MIMAT0000416 | 876 | UGGAAUGUAAAGAAGUAUGUAU | 877 | UGGAAUGUAAAGAAGUAUGU | 878 | UUCUUUACAUUCCA |
| hsa-miR-100 MIMAT0000098 | 879 | AACCCGUAGAUCCGAACUUGUG | 880 | AACCCGUAGAUCCGAACUUG | 881 | CGGAUCUACGGGUU |
| hsa-miR-100* MIMAT0004512 | 882 | CAAGCUUGUAUCUAUAGGUAUG | 883 | CAAGCUUGUAUCUAUAGGUA | 884 | UAGAUACAAGCUUG |
| hsa-miR-101 MIMAT0000099 | 885 | UACAGUACUGUGAUAACUGAA | 886 | UACAGUACUGUGAUAACUGA | 887 | AUCACAGUACUGUA |
| hsa-miR-101* MIMAT0004513 | 888 | CAGUUAUCACAGUGCUGAUGCU | 889 | CAGUUAUCACAGUGCUGAUG | 890 | CACUGUGAUAACUG |
| hsa-miR-103 MIMAT0000101 | 891 | AGCAGCAUUGUACAGGGCUAUGA | 892 | AGCAGCAUUGUACAGGGCUA | 893 | UGUACAAUGCUGCU |
| hsa-miR-103-2* MIMAT0009196 | 894 | AGCUUCUUUACAGUGCUGCCUUG | 895 | AGCUUCUUUACAGUGCUGCC | 896 | ACUGUAAAGAAGCU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-103-as MIMAT0007402 | 897 | UCAUAGCCCUGUACAAU GCUGCU | 898 | UCAUAGCCCUGU ACAAUGCU | 899 | GUACAGGGCUA UGA |
| hsa-miR-105 MIMAT0000102 | 900 | UCAAAUGCUCAGACUCC UGUGGU | 901 | UCAAAUGCUCAG ACUCCUGU | 902 | GUCUGAGCAUU UGA |
| hsa-miR-105* MIMAT0004516 | 903 | ACGGAUGUUUGAGCAUG UGCUA | 904 | ACGGAUGUUUGA GCAUGUGC | 905 | GCUCAAACAUC CGU |
| hsa-miR-106a MIMAT0000103 | 906 | AAAGUGCUUACAGUGC AGGUAG | 907 | AAAGUGCUUAC AGUGCAGG | 908 | CUGUAAGCACU UUU |
| hsa-miR-106a* MIMAT0004517 | 909 | CUGCAAUGUAAGCACUU CUUAC | 910 | CUGCAAUGUAAG CACUUCUU | 911 | UGCUUACAUUG CAG |
| hsa-miR-106b MIMAT0000680 | 912 | UAAAGUGCUGACAGUGC AGAU | 913 | UAAAGUGCUGAC AGUGCAGA | 914 | CUGUCAGCACU UUA |
| hsa-miR-106b* MIMAT0004672 | 915 | CCGCACUGUGGGUACUU GCUGC | 916 | CCGCACUGUGGG UACUUGCU | 917 | UACCCACAGUG CGG |
| hsa-miR-107 MIMAT0000104 | 918 | AGCAGCAUUGUACAGGG CUAUCA | 919 | AGCAGCAUUGUA CAGGGCUA | 920 | UGUACAAUGCU GCU |
| hsa-miR-10a MIMAT0000253 | 921 | UACCCUGUAGAUCCGAA UUUGUG | 922 | UACCCUGUAGAU CCGAAUUU | 923 | GGAUCUACAGG GUA |
| hsa-miR-10a* MIMAT0004555 | 924 | CAAAUUCGUAUCUAGGG GAAUA | 925 | CAAAUUCGUAUC UAGGGGAA | 926 | UAGAUACGAAU UUG |
| hsa-miR-10b MIMAT0000254 | 927 | UACCCUGUAGAACCGAA UUUGUG | 928 | UACCCUGUAGAA CCGAAUUU | 929 | GGUUCUACAGG GUA |
| hsa-miR-10b* MIMAT0004556 | 930 | ACAGAUUCGAUUCUAGG GGAAU | 931 | ACAGAUUCGAUU CUAGGGGA | 932 | AGAAUCGAAUC UGU |
| hsa-miR-1178 MIMAT0005823 | 933 | UUGCUCACUGUUCUUCC CUAG | 934 | UUGCUCACUGUU CUUCCCUA | 935 | AGAACAGUGAG CAA |
| hsa-miR-1179 MIMAT0005824 | 936 | AAGCAUUCUUUCAUUGG UUGG | 937 | AAGCAUUCUUUC AUUGGUUG | 938 | AUGAAAGAAUG CUU |
| hsa-miR-1180 MIMAT0005825 | 939 | UUUCCGGCUCGCGUGGG UGUGU | 940 | UUUCCGGCUCGC GUGGGUGU | 941 | ACGCGAGCCGG AAA |
| hsa-miR-1181 MIMAT0005826 | 942 | CCGUCGCCGCCACCCGA GCCG | 943 | CCGUCGCCGCCA CCCGAGCC | 944 | GGUGGCGGCGA CGG |
| hsa-miR-1182 MIMAT0005827 | 945 | GAGGGUCUUGGGAGGGA UGUGAC | 946 | GAGGGUCUUGGG AGGGAUGU | 947 | CUCCCAAGACC CUC |
| hsa-miR-1183 MIMAT0005828 | 948 | CACUGUAGGUGAUGGUG AGAGUGGCA | 949 | CACUGUAGGUGA UGGUGAGA | 950 | CAUCACCUACA GUG |
| hsa-miR-1184 MIMAT0005829 | 951 | CCUGCAGCGACUUGAUG GCUUCC | 952 | CCUGCAGCGACU UGAUGGCU | 953 | CAAGUCGCUGC AGG |
| hsa-miR-1185 MIMAT0005798 | 954 | AGAGGAUACCCUUUGUA UGUU | 955 | AGAGGAUACCCU UUGUAUGU | 956 | AAAGGGUAUCC UCU |
| hsa-miR-1193 MIMAT0015049 | 957 | GGGAUGGUAGACCGGUG ACGUGC | 958 | GGGAUGGUAGAC CGGUGACG | 959 | CGGUCUACCAU CCC |
| hsa-miR-1197 MIMAT0005955 | 960 | UAGGACACAUGGUCUAC UUCU | 961 | UAGGACACAUGG UCUACUUC | 962 | GACCAUGUGUC CUA |
| hsa-miR-1200 MIMAT0005863 | 963 | CUCCUGAGCCAUUCUGA GCCUC | 964 | CUCCUGAGCCAU UCUGAGCC | 965 | GAAUGGCUCAG GAG |
| hsa-miR-1202 MIMAT0005865 | 966 | GUGCCAGCUGCAGUGGG GGAG | 967 | GUGCCAGCUGCA GUGGGGGA | 968 | ACUGCAGCUGG CAC |
| hsa-miR-1203 MIMAT0005866 | 969 | CCCGGAGCCAGGAUGCA GCUC | 970 | CCCGGAGCCAGG AUGCAGCU | 971 | AUCCUGGCUCC GGG |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-1204 MIMAT0005868 | 972 | UCGUGGCCUGGUCUCCAUUAU | 973 | UCGUGGCCUGGUCUCCAUUA | 974 | AGACCAGGCCACGA |
| hsa-miR-1205 MIMAT0005869 | 975 | UCUGCAGGGUUUGCUUUGAG | 976 | UCUGCAGGGUUUGCUUUGAG | 977 | GCAAACCCUGCAGA |
| hsa-miR-1206 MIMAT0005870 | 978 | UGUUCAUGUAGAUGUUUAAGC | 979 | UGUUCAUGUAGAUGUUUAAG | 980 | CAUCUACAUGAACA |
| hsa-miR-1207-3p MIMAT0005872 | 981 | UCAGCUGGCCCUCAUUUC | 982 | UCAGCUGGCCCUCAUUUC | 983 | UGAGGGCCAGCUGA |
| hsa-miR-1207-5p MIMAT0005871 | 984 | UGGCAGGGAGGCUGGGAGGGG | 985 | UGGCAGGGAGGCUGGGAGGG | 986 | CAGCCUCCCUGCCA |
| hsa-miR-1208 MIMAT0005873 | 987 | UCACUGUUCAGACAGGCGGA | 988 | UCACUGUUCAGACAGGCGGA | 989 | UGUCUGAACAGUGA |
| hsa-miR-122 MIMAT0000421 | 990 | UGGAGUGUGACAAUGGUGUUUG | 991 | UGGAGUGUGACAAUGGUGUU | 992 | AUUGUCACACUCCA |
| hsa-miR-122* MIMAT0004590 | 993 | AACGCCAUUAUCACACUAAAUA | 994 | AACGCCAUUAUCACACUAAA | 995 | GUGAUAAUGGCGUU |
| hsa-miR-1224-3p MIMAT0005459 | 996 | CCCCACCUCCUCUCUCCUCAG | 997 | CCCCACCUCCUCUCUCCUCA | 998 | GAGAGGAGGUGGGG |
| hsa-miR-1224-5p MIMAT0005458 | 999 | GUGAGGACUCGGGAGGUGG | 1000 | GUGAGGACUCGGGAGGUGG | 1001 | UCCCGAGUCCUCAC |
| hsa-miR-1225-3p MIMAT0005573 | 1002 | UGAGCCCCUGUGCCGCCCCAG | 1003 | UGAGCCCCUGUGCCGCCCCC | 1004 | GGCACAGGGGCUCA |
| hsa-miR-1225-5p MIMAT0005572 | 1005 | GUGGGUACGGCCCAGUGGGGG | 1006 | GUGGGUACGGCCCAGUGGGG | 1007 | UGGGCCGUACCCAC |
| hsa-miR-1226 MIMAT0005577 | 1008 | UCACCAGCCCUGUGUUCCCUAG | 1009 | UCACCAGCCCUGUGUUCCCU | 1010 | CACAGGGCUGGUGA |
| hsa-miR-1226* MIMAT0005576 | 1011 | GUGAGGGCAUGCAGGCCUGGAUGGGG | 1012 | GUGAGGGCAUGCAGGCCUGG | 1013 | CUGCAUGCCCUCAC |
| hsa-miR-1227 MIMAT0005580 | 1014 | CGUGCCACCCUUUUCCCCAG | 1015 | CGUGCCACCCUUUUCCCCAG | 1016 | AAAAGGGUGGCACG |
| hsa-miR-1228 MIMAT0005583 | 1017 | UCACACCUGCCUCGCCCCCC | 1018 | UCACACCUGCCUCGCCCCCC | 1019 | CGAGGCAGGUGUGA |
| hsa-miR-1228* MIMAT0005582 | 1020 | GUGGGCGGGGCAGGUGUGUG | 1021 | GUGGGCGGGGCAGGUGUGU | 1022 | CUGCCCCCGCCCAC |
| hsa-miR-1229 MIMAT0005584 | 1023 | CUCUCACCACUGCCCUCCCACAG | 1024 | CUCUCACCACUGCCCUCCCA | 1025 | GGCAGUGGUGAGAG |
| hsa-miR-1231 MIMAT0005586 | 1026 | GUGUCUGGGCGGACAGCUGC | 1027 | GUGUCUGGGCGGACAGCUGC | 1028 | GUCCGCCCAGACAC |
| hsa-miR-1233 MIMAT0005588 | 1029 | UGAGCCCUGUCCUCCCGCAG | 1030 | UGAGCCCUGUCCUCCCGCAG | 1031 | GAGGACAGGGCUCA |
| hsa-miR-1234 MIMAT0005589 | 1032 | UCGGCCUGACCACCCCACCCAC | 1033 | UCGGCCUGACCACCCCACCCC | 1034 | GGUGGUCAGGCCGA |
| hsa-miR-1236 MIMAT0005591 | 1035 | CCUCUUCCCCUUGUCUCUCCAG | 1036 | CCUCUUCCCCUUGUCUCUCC | 1037 | ACAAGGGGAAGAGG |
| hsa-miR-1237 MIMAT0005592 | 1038 | UCCUUCUGCUCCGUCCCCCAG | 1039 | UCCUUCUGCUCCGUCCCCCA | 1040 | ACGGAGCAGAAGGA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-1238 MIMAT0005593 | 1041 | CUUCCUCGUCUGUCUGC CCC | 1042 | CUUCCUCGUCUG UCUGCCCC | 1043 | GACAGACGAGG AAG |
| hsa-miR-124 MIMAT0000422 | 1044 | UAAGGCACGCGGUGAAU GCC | 1045 | UAAGGCACGCGG UGAAUGCC | 1046 | CACCGCGUGCC UUA |
| hsa-miR-124* MIMAT0004591 | 1047 | CGUGUUCACAGCGGACC UUGAU | 1048 | CGUGUUCACAGC GGACCUUG | 1049 | CCGCUGUGAAC ACG |
| hsa-miR-1243 MIMAT0005894 | 1050 | AACUGGAUCAAUUAUAG GAGUG | 1051 | AACUGGAUCAAU UAUAGGAG | 1052 | UAAUUGAUCCA GUU |
| hsa-miR-1244 MIMAT0005896 | 1053 | AAGUAGUUGGUUUGUAU GAGAUGGUU | 1054 | AAGUAGUUGGUU UGUAUGAG | 1055 | CAAACCAACUA CUU |
| hsa-miR-1245 MIMAT0005897 | 1056 | AAGUGAUCUAAAGGCCU ACAU | 1057 | AAGUGAUCUAAA GGCCUACA | 1058 | CCUUUAGAUCA CUU |
| hsa-miR-1246 MIMAT0005898 | 1059 | AAUGGAUUUUUGGAGCA GG | 1060 | AAUGGAUUUUUG GAGCAGG | 1061 | UCCAAAAAUCC AUU |
| hsa-miR-1247 MIMAT0005899 | 1062 | ACCCGUCCCGUUCGUCC CCGGA | 1063 | ACCCGUCCCGUU CGUCCCCG | 1064 | CGAACGGGACG GGU |
| hsa-miR-1248 MIMAT0005900 | 1065 | ACCUUCUUGUAUAAGCA CUGUGCUAAA | 1066 | ACCUUCUUGUAU AAGCACUG | 1067 | UUAUACAAGAA GGU |
| hsa-miR-1249 MIMAT0005901 | 1068 | ACGCCCUUCCCCCCCUU CUUCA | 1069 | ACGCCCUUCCCC CCCUUCUU | 1070 | GGGGGGAAGGG CGU |
| hsa-miR-1250 MIMAT0005902 | 1071 | ACGGUGCUGGAUGUGGC CUUU | 1072 | ACGGUGCUGGAU GUGGCCUU | 1073 | ACAUCCAGCAC CGU |
| hsa-miR-1251 MIMAT0005903 | 1074 | ACUCUAGCUGCCAAAGG CGCU | 1075 | ACUCUAGCUGCC AAAGGCGC | 1076 | UUGGCAGCUAG AGU |
| hsa-miR-1252 MIMAT0005944 | 1077 | AGAAGGAAAUUGAAUUC AUUUA | 1078 | AGAAGGAAAUUG AAUUCAUU | 1079 | UUCAAUUCCU UCU |
| hsa-miR-1253 MIMAT0005904 | 1080 | AGAGAAGAAGAUCAGCC UGCA | 1081 | AGAGAAGAAGAU CAGCCUGC | 1082 | UGAUCUUCUUC UCU |
| hsa-miR-1254 MIMAT0005905 | 1083 | AGCCUGGAAGCUGGAGC CUGCAGU | 1084 | AGCCUGGAAGCU GGAGCCUG | 1085 | CCAGCUUCCAG GCU |
| hsa-miR-1255a MIMAT0005906 | 1086 | AGGAUGAGCAAAGAAAG UAGAUU | 1087 | AGGAUGAGCAAA GAAAGUAG | 1088 | UCUUUGCUCAU CCU |
| hsa-miR-1255b MIMAT0005945 | 1089 | CGGAUGAGCAAAGAAAG UGGUU | 1090 | CGGAUGAGCAAA GAAAGUGG | 1091 | UCUUUGCUCAU CCG |
| hsa-miR-1256 MIMAT0005907 | 1092 | AGGCAUUGACUUCUCAC UAGCU | 1093 | AGGCAUUGACUU CUCACUAG | 1094 | AGAAGUCAAUG CCU |
| hsa-miR-1257 MIMAT0005908 | 1095 | AGUGAAUGAUGGGUUCU GACC | 1096 | AGUGAAUGAUGG GUUCUGAC | 1097 | ACCCAUCAUUC ACU |
| hsa-miR-1258 MIMAT0005909 | 1098 | AGUUAGGAUUAGGUCGU GGAA | 1099 | AGUUAGGAUUAG GUCGUGGA | 1100 | ACCUAAUCCUA ACU |
| hsa-miR-125a-3p MIMAT0004602 | 1101 | ACAGGUGAGGUUCUUGG GAGCC | 1102 | ACAGGUGAGGUU CUUGGGAG | 1103 | AGAACCUCACC UGU |
| hsa-miR-125a-5p MIMAT0000443 | 1104 | UCCCUGAGACCCUUUAA CCUGUGA | 1105 | UCCCUGAGACCC UUUAACCU | 1106 | AAGGGUCUCAG GGA |
| hsa-miR-125b MIMAT0000423 | 1107 | UCCCUGAGACCCUAACU UGUGA | 1108 | UCCCUGAGACCC UAACUUGU | 1109 | UAGGGUCUCAG GGA |
| hsa-miR-125b-1* MIMAT0004592 | 1110 | ACGGGUUAGGCUCUUGG GAGCU | 1111 | ACGGGUUAGGCU CUUGGGAG | 1112 | AGAGCCUAACC CGU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-125b-2* MIMAT0004603 | 1113 | UCACAAGUCAGGCUCUU GGGAC | 1114 | UCACAAGUCAGG CUCUUGGG | 1115 | AGCCUGACUUG UGA |
| hsa-miR-126 MIMAT0000445 | 1116 | UCGUACCGUGAGUAAUA AUGCG | 1117 | UCGUACCGUGAG UAAUAAUG | 1118 | UACUCACGGUA CGA |
| hsa-miR-126* MIMAT0000444 | 1119 | CAUUAUUACUUUUGGUA CGCG | 1120 | CAUUAUUACUUU UGGUACGC | 1121 | CAAAAGUAAUA AUG |
| hsa-miR-1260 MIMAT0005911 | 1122 | AUCCCACCUCUGCCACCA | 1123 | AUCCCACCUCUG CCACCA | 1124 | GGCAGAGGUGG GAU |
| hsa-miR-1260b MIMAT0015041 | 1125 | AUCCCACCACUGCCACC AU | 1126 | AUCCCACCACUG CCACCAU | 1127 | GGCAGUGGUGG GAU |
| hsa-miR-1261 MIMAT0005913 | 1128 | AUGGAUAAGGCUUUGGC UU | 1129 | AUGGAUAAGGCU UUGGCUU | 1130 | AAAGCCUUAUC CAU |
| hsa-miR-1262 MIMAT0005914 | 1131 | AUGGGUGAAUUUGUAGA AGGAU | 1132 | AUGGGUGAAUUU GUAGAAGG | 1133 | ACAAAUUCACC CAU |
| hsa-miR-1263 MIMAT0005915 | 1134 | AUGGUACCCUGGCAUAC UGAGU | 1135 | AUGGUACCCUGG CAUACUGA | 1136 | UGCCAGGGUAC CAU |
| hsa-miR-1264 MIMAT0005791 | 1137 | CAAGUCUUAUUUGAGCA CCUGUU | 1138 | CAAGUCUUAUUU GAGCACCU | 1139 | UCAAAUAAGAC UUG |
| hsa-miR-1265 MIMAT0005918 | 1140 | CAGGAUGUGGUCAAGUG UUGUU | 1141 | CAGGAUGUGGUC AAGUGUUG | 1142 | UUGACCACAUC CUG |
| hsa-miR-1266 MIMAT0005920 | 1143 | CCUCAGGGCUGUAGAAC AGGGCU | 1144 | CCUCAGGGCUGU AGAACAGG | 1145 | CUACAGCCCUG AGG |
| hsa-miR-1267 MIMAT0005921 | 1146 | CCUGUUGAAGUGUAAUC CCCA | 1147 | CCUGUUGAAGUG UAAUCCCC | 1148 | UACACUUCAAC AGG |
| hsa-miR-1268 MIMAT0005922 | 1149 | CGGGCGUGGUGGUGGGGG | 1150 | CGGGCGUGGUGG UGGGGG | 1151 | CACCACCACGC CCG |
| hsa-miR-1269 MIMAT0005923 | 1152 | CUGGACUGAGCCGUGCU ACUGG | 1153 | CUGGACUGAGCC GUGCUACU | 1154 | ACGGCUCAGUC CAG |
| hsa-miR-1270 MIMAT0005924 | 1155 | CUGGAGAUAUGGAAGAG CUGUGU | 1156 | CUGGAGAUAUGG AAGAGCUG | 1157 | UUCCAUAUCUC CAG |
| hsa-miR-1271 MIMAT0005796 | 1158 | CUUGGCACCUAGCAAGC ACUCA | 1159 | CUUGGCACCUAG CAAGCACU | 1160 | UGCUAGGUGCC AAG |
| hsa-miR-1272 MIMAT0005925 | 1161 | GAUGAUGAUGGCAGCAA AUUCUGAAA | 1162 | GAUGAUGAUGGC AGCAAAUU | 1163 | CUGCCAUCAUC AUC |
| hsa-miR-1273 MIMAT0005926 | 1164 | GGGCGACAAAGCAAGAC UCUUUCUU | 1165 | GGGCGACAAAGC AAGACUCU | 1166 | UUGCUUUGUCG CCC |
| hsa-miR-1273c MIMAT0015017 | 1167 | GGCGACAAAACGAGACC CUGUC | 1168 | GGCGACAAAACG AGACCCUG | 1169 | CUCGUUUUGUC GCC |
| hsa-miR-1273d MIMAT0015090 | 1170 | GAACCCAUGAGGUUGAG GCUGCAGU | 1171 | GAACCCAUGAGG UUGAGGCU | 1172 | AACCUCAUGGG UUC |
| hsa-miR-1273e MIMAT0018079 | 1173 | UUGCUUGAACCCAGGAA GUGGA | 1174 | UUGCUUGAACCC AGGAAGUG | 1175 | CUGGGUUCAAG CAA |
| hsa-miR-127-3p MIMAT0000446 | 1176 | UCGGAUCCGUCUGAGCU UGGCU | 1177 | UCGGAUCCGUCU GAGCUUGG | 1178 | UCAGACGGAUC CGA |
| hsa-miR-1274a MIMAT0005927 | 1179 | GUCCCUGUUCAGGCGCCA | 1180 | GUCCCUGUUCAG GCGCCA | 1181 | GCCUGAACAGG GAC |
| hsa-miR-1274b MIMAT0005938 | 1182 | UCCCUGUUCGGGCGCCA | 1183 | UCCCUGUUCGGG CGCCA | 1184 | CGCCCGAACAG GGA |
| hsa-miR-1275 MIMAT0005929 | 1185 | GUGGGGGAGAGGCUGUC | 1186 | GUGGGGGAGAGG CUGUC | 1187 | AGCCUCUCCCC CAC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-127-5p MIMAT0004604 | 1188 | CUGAAGCUCAGAGGGCU CUGAU | 1189 | CUGAAGCUCAGA GGGCUCUG | 1190 | CCUCUGAGCUU CAG |
| hsa-miR-1276 MIMAT0005930 | 1191 | UAAAGAGCCCUGUGGAG ACA | 1192 | UAAAGAGCCCUG UGGAGACA | 1193 | CACAGGGCUCU UUA |
| hsa-miR-1277 MIMAT0005933 | 1194 | UACGUAGAUAUAUAUGU AUUUU | 1195 | UACGUAGAUAUA UAUGUAUU | 1196 | UAUAUAUCUAC GUA |
| hsa-miR-1278 MIMAT0005936 | 1197 | UAGUACUGUGCAUAUCA UCUAU | 1198 | UAGUACUGUGCA UAUCAUCU | 1199 | UAUGCACAGUA CUA |
| hsa-miR-1279 MIMAT0005937 | 1200 | UCAUAUUGCUUCUUUCU | 1201 | UCAUAUUGCUUC UUUCU | 1202 | AAGAAGCAAUA UGA |
| hsa-miR-128 MIMAT0000424 | 1203 | UCACAGUGAACCGGUCU CUUU | 1204 | UCACAGUGAACC GGUCUCUU | 1205 | CCGGUUCACUG UGA |
| hsa-miR-1280 MIMAT0005946 | 1206 | UCCCACCGCUGCCACCC | 1207 | UCCCACCGCUGC CACCC | 1208 | UGGCAGCGGUG GGA |
| hsa-miR-1281 MIMAT0005939 | 1209 | UCGCCUCCUCCUCUCCC | 1210 | UCGCCUCCUCCU CUCCC | 1211 | AGAGGAGGAGG CGA |
| hsa-miR-1282 MIMAT0005940 | 1212 | UCGUUUGCCUUUUUCUG CUU | 1213 | UCGUUUGCCUUU UUCUGCUU | 1214 | AAAAAGGCAAA CGA |
| hsa-miR-1283 MIMAT0005799 | 1215 | UCUACAAAGGAAAGCGC UUUCU | 1216 | UCUACAAAGGAA AGCGCUUU | 1217 | CUUUCCUUUGU AGA |
| hsa-miR-1284 MIMAT0005941 | 1218 | UCUAUACAGACCCUGGC UUUUC | 1219 | UCUAUACAGACC CUGGCUUU | 1220 | AGGGUCUGUAU AGA |
| hsa-miR-1285 MIMAT0005876 | 1221 | UCUGGGCAACAAAGUGA GACCU | 1222 | UCUGGGCAACAA AGUGAGAC | 1223 | CUUUGUUGCCC AGA |
| hsa-miR-1286 MIMAT0005877 | 1224 | UGCAGGACCAAGAUGAG CCCU | 1225 | UGCAGGACCAAG AUGAGCCC | 1226 | AUCUUGGUCCU GCA |
| hsa-miR-1287 MIMAT0005878 | 1227 | UGCUGGAUCAGUGGUUC GAGUC | 1228 | UGCUGGAUCAGU GGUUCGAG | 1229 | CCACUGAUCCA GCA |
| hsa-miR-1288 MIMAT0005942 | 1230 | UGGACUGCCCUGAUCUG GAGA | 1231 | UGGACUGCCCUG AUCUGGAG | 1232 | AUCAGGGCAGU CCA |
| hsa-miR-1289 MIMAT0005879 | 1233 | UGGAGUCCAGGAAUCUG CAUUUU | 1234 | UGGAGUCCAGGA AUCUGCAU | 1235 | AUUCCUGGACU CCA |
| hsa-miR-129* MIMAT0004548 | 1236 | AAGCCCUUACCCCAAAA AGUAU | 1237 | AAGCCCUUACCC CAAAAAGU | 1238 | UGGGGUAAGGG CUU |
| hsa-miR-1290 MIMAT0005880 | 1239 | UGGAUUUUUGGAUCAGG GA | 1240 | UGGAUUUUUGGA UCAGGGA | 1241 | GAUCCAAAAAU CCA |
| hsa-miR-1291 MIMAT0005881 | 1242 | UGGCCCUGACUGAAGAC CAGCAGU | 1243 | UGGCCCUGACUG AAGACCAG | 1244 | UUCAGUCAGGG CCA |
| hsa-miR-1292 MIMAT0005943 | 1245 | UGGGAACGGGUUCCGGC AGACGCUG | 1246 | UGGGAACGGGUU CCGGCAGA | 1247 | GGAACCCGUUC CCA |
| hsa-miR-1293 MIMAT0005883 | 1248 | UGGGUGGUCUGGAGAUU UGUGC | 1249 | UGGGUGGUCUGG AGAUUUGU | 1250 | CUCCAGACCAC CCA |
| hsa-miR-129-3p MIMAT0004605 | 1251 | AAGCCCUUACCCCAAAA AGCAU | 1252 | AAGCCCUUACCC CAAAAAGC | 1253 | UGGGGUAAGGG CUU |
| hsa-miR-1294 MIMAT0005884 | 1254 | UGUGAGGUUGGCAUUGU UGUCU | 1255 | UGUGAGGUUGGC AUUGUUGU | 1256 | AUGCCAACCUC ACA |
| hsa-miR-1295 MIMAT0005885 | 1257 | UUAGGCCGCAGAUCUGG GUGA | 1258 | UUAGGCCGCAGA UCUGGGUG | 1259 | GAUCUGCGGCC UAA |
| hsa-miR-129-5p MIMAT0000242 | 1260 | CUUUUUGCGGUCUGGGC UUGC | 1261 | CUUUUUGCGGUC UGGGCUUG | 1262 | CAGACCGCAAA AAG |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-1296 MIMAT0005794 | 1263 | UUAGGGCCCUGGCUCCA UCUCC | 1264 | UUAGGGCCCUGG CUCCAUCU | 1265 | AGCCAGGGCCC UAA |
| hsa-miR-1297 MIMAT0005886 | 1266 | UUCAAGUAAUUCAGGUG | 1267 | UUCAAGUAAUUC AGGUG | 1268 | CUGAAUUACUU GAA |
| hsa-miR-1298 MIMAT0005800 | 1269 | UUCAUUCGGCUGUCCAG AUGUA | 1270 | UUCAUUCGGCUG UCCAGAUG | 1271 | GACAGCCGAAU GAA |
| hsa-miR-1299 MIMAT0005887 | 1272 | UUCUGGAAUUCUGUGUG AGGGA | 1273 | UUCUGGAAUUCU GUGUGAGG | 1274 | ACAGAAUUCCA GAA |
| hsa-miR-1301 MIMAT0005797 | 1275 | UUGCAGCUGCCUGGGAG UGACUUC | 1276 | UUGCAGCUGCCU GGGAGUGA | 1277 | CCAGGCAGCUG CAA |
| hsa-miR-1302 MIMAT0005890 | 1278 | UUGGGACAUACUUAUGC UAAA | 1279 | UUGGGACAUACU UAUGCUAA | 1280 | UAAGUAUGUCC CAA |
| hsa-miR-1303 MIMAT0005891 | 1281 | UUUAGAGACGGGGUCUU GCUCU | 1282 | UUUAGAGACGGG GUCUUGCU | 1283 | ACCCCGUCUCU AAA |
| hsa-miR-1304 MIMAT0005892 | 1284 | UUUGAGGCUACAGUGAG AUGUG | 1285 | UUUGAGGCUACA GUGAGAUG | 1286 | ACUGUAGCCUC AAA |
| hsa-miR-1305 MIMAT0005893 | 1287 | UUUUCAACUCUAAUGGG AGAGA | 1288 | UUUUCAACUCUA AUGGGAGA | 1289 | AUUAGAGUUGA AAA |
| hsa-miR-1306 MIMAT0005950 | 1290 | ACGUUGGCUCUGGUGGUG | 1291 | ACGUUGGCUCUG GUGGUG | 1292 | ACCAGAGCCAA CGU |
| hsa-miR-1307 MIMAT0005951 | 1293 | ACUCGGCGUGGCGUCGG UCGUG | 1294 | ACUCGGCGUGGC GUCGGUCG | 1295 | ACGCCACGCCG AGU |
| hsa-miR-130a MIMAT0000425 | 1296 | CAGUGCAAUGUUAAAAG GGCAU | 1297 | CAGUGCAAUGUU AAAAGGGC | 1298 | UUAACAUUGCA CUG |
| hsa-miR-130a* MIMAT0004593 | 1299 | UUCACAUUGUGCUACUG UCUGC | 1300 | UUCACAUUGUGC UACUGUCU | 1301 | UAGCACAAUGU GAA |
| hsa-miR-130b MIMAT0000691 | 1302 | CAGUGCAAUGAUGAAAG GGCAU | 1303 | CAGUGCAAUGAU GAAAGGGC | 1304 | UCAUCAUUGCA CUG |
| hsa-miR-130b* MIMAT0004680 | 1305 | ACUCUUUCCCUGUUGCA CUAC | 1306 | ACUCUUUCCCUG UUGCACUA | 1307 | AACAGGGAAAG AGU |
| hsa-miR-132 MIMAT0000426 | 1308 | UAACAGUCUACAGCCAU GGUCG | 1309 | UAACAGUCUACA GCCAUGGU | 1310 | GCUGUAGACUG UUA |
| hsa-miR-132* MIMAT0004594 | 1311 | ACCGUGGCUUUCGAUUG UUACU | 1312 | ACCGUGGCUUUC GAUUGUUA | 1313 | UCGAAAGCCAC GGU |
| hsa-miR-1321 MIMAT0005952 | 1314 | CAGGGAGGUGAAUGUGAU | 1315 | CAGGGAGGUGAA UGUGAU | 1316 | CAUUCACCUCC CUG |
| hsa-miR-1322 MIMAT0005953 | 1317 | GAUGAUGCUGCUGAUGC UG | 1318 | GAUGAUGCUGCU GAUGCUG | 1319 | UCAGCAGCAUC AUC |
| hsa-miR-1323 MIMAT0005795 | 1320 | UCAAAACUGAGGGGCAU UUUCU | 1321 | UCAAAACUGAGG GGCAUUUU | 1322 | CCCCUCAGUUU UGA |
| hsa-miR-1324 MIMAT0005956 | 1323 | CCAGACAGAAUUCUAUG CACUUUC | 1324 | CCAGACAGAAUU CUAUGCAC | 1325 | AGAAUUCUGUC UGG |
| hsa-miR-133a MIMAT0000427 | 1326 | UUUGGUCCCCUUCAACC AGCUG | 1327 | UUUGGUCCCCUU CAACCAGC | 1328 | UGAAGGGGACC AAA |
| hsa-miR-133b MIMAT0000770 | 1329 | UUUGGUCCCCUUCAACC AGCUA | 1330 | UUUGGUCCCCUU CAACCAGC | 1331 | UGAAGGGGACC AAA |
| hsa-miR-134 MIMAT0000447 | 1332 | UGUGACUGGUUGACCAG AGGGG | 1333 | UGUGACUGGUUG ACCAGAGG | 1334 | GUCAACCAGUC ACA |
| hsa-miR-135a MIMAT0000428 | 1335 | UAUGGCUUUUUAUUCCU AUGUGA | 1336 | UAUGGCUUUUUA UUCCUAUG | 1337 | AAUAAAAGCC AUA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-135a* MIMAT0004595 | 1338 | UAUAGGGAUUGGAGCCG UGGCG | 1339 | UAUAGGGAUUGG AGCCGUGG | 1340 | CUCCAAUCCCU AUA |
| hsa-miR-135b MIMAT0000758 | 1341 | UAUGGCUUUUCAUUCCU AUGUGA | 1342 | UAUGGCUUUUCA UUCCUAUG | 1343 | AAUGAAAAGCC AUA |
| hsa-miR-135b* MIMAT0004698 | 1344 | AUGUAGGGCUAAAAGCC AUGGG | 1345 | AUGUAGGGCUAA AAGCCAUG | 1346 | UUUUAGCCCUA CAU |
| hsa-miR-136 MIMAT0000448 | 1347 | ACUCCAUUUGUUUUGAU GAUGGA | 1348 | ACUCCAUUUGUU UUGAUGAU | 1349 | AAAACAAAUGG AGU |
| hsa-miR-136* MIMAT0004606 | 1350 | CAUCAUCGUCUCAAAUG AGUCU | 1351 | CAUCAUCGUCUC AAAUGAGU | 1352 | UUGAGACGAUG AUG |
| hsa-miR-137 MIMAT0000429 | 1353 | UUAUUGCUUAAGAAUAC GCGUAG | 1354 | UUAUUGCUUAAG AAUACGCG | 1355 | UUCUUAAGCAA UAA |
| hsa-miR-138 MIMAT0000430 | 1356 | AGCUGGUGUUGUGAAUC AGGCCG | 1357 | AGCUGGUGUUGU GAAUCAGG | 1358 | UCACAACACCA GCU |
| hsa-miR-138-1* MIMAT0004607 | 1359 | GCUACUUCACAACACCA GGGCC | 1360 | GCUACUUCACAA CACCAGGG | 1361 | UGUUGUGAAGU AGC |
| hsa-miR-138-2* MIMAT0004596 | 1362 | GCUAUUUCACGACACCA GGGUU | 1363 | GCUAUUUCACGA CACCAGGG | 1364 | UGUCGUGAAAU AGC |
| hsa-miR-139-3p MIMAT0004552 | 1365 | GGAGACGCGGCCCUGUU GGAGU | 1366 | GGAGACGCGGCC CUGUUGGA | 1367 | AGGGCCGCGUC UCC |
| hsa-miR-139-5p MIMAT0000250 | 1368 | UCUACAGUGCACGUGUC UCCAG | 1369 | UCUACAGUGCAC GUGUCUCC | 1370 | ACGUGCACUGU AGA |
| hsa-miR-140-3p MIMAT0004597 | 1371 | UACCACAGGGUAGAACC ACGG | 1372 | UACCACAGGGUA GAACCACG | 1373 | UCUACCCUGUG GUA |
| hsa-miR-140-5p MIMAT0000431 | 1374 | CAGUGGUUUUACCCUAU GGUAG | 1375 | CAGUGGUUUUAC CCUAUGGU | 1376 | GGGUAAAACCA CUG |
| hsa-miR-141 MIMAT0000432 | 1377 | UAACACUGUCUGGUAAA GAUGG | 1378 | UAACACUGUCUG GUAAAGAU | 1379 | ACCAGACAGUG UUA |
| hsa-miR-141* MIMAT0004598 | 1380 | CAUCUUCCAGUACAGUG UUGGA | 1381 | CAUCUUCCAGUA CAGUGUUG | 1382 | UGUACUGGAAG AUG |
| hsa-miR-142-3p MIMAT0000434 | 1383 | UGUAGUGUUUCCUACUU UAUGGA | 1384 | UGUAGUGUUUCC UACUUUAU | 1385 | UAGGAAACACU ACA |
| hsa-miR-142-5p MIMAT0000433 | 1386 | CAUAAAGUAGAAAGCAC UACU | 1387 | CAUAAAGUAGAA AGCACUAC | 1388 | CUUUCUACUUU AUG |
| hsa-miR-143 MIMAT0000435 | 1389 | UGAGAUGAAGCACUGUA GCUC | 1390 | UGAGAUGAAGCA CUGUAGCU | 1391 | AGUGCUUCAUC UCA |
| hsa-miR-143* MIMAT0004599 | 1392 | GGUGCAGUGCUGCAUCU CUGGU | 1393 | GGUGCAGUGCUG CAUCUCUG | 1394 | UGCAGCACUGC ACC |
| hsa-miR-144 MIMAT0000436 | 1395 | UACAGUAUAGAUGAUGU ACU | 1396 | UACAGUAUAGAU GAUGUACU | 1397 | UCAUCUAUACU GUA |
| hsa-miR-144* MIMAT0004600 | 1398 | GGAUAUCAUCAUAUACU GUAAG | 1399 | GGAUAUCAUCAU AUACUGUA | 1400 | AUAUGAUGAUA UCC |
| hsa-miR-145 MIMAT0000437 | 1401 | GUCCAGUUUUCCCAGGA AUCCCU | 1402 | GUCCAGUUUUCC CAGGAAUC | 1403 | UGGGAAAACUG GAC |
| hsa-miR-145* MIMAT0004601 | 1404 | GGAUUCCUGGAAAUACU GUUCU | 1405 | GGAUUCCUGGAA AUACUGUU | 1406 | AUUUCCAGGAA UCC |
| hsa-miR-1468 MIMAT0006789 | 1407 | CUCCGUUUGCCUGUUUC GCUG | 1408 | CUCCGUUUGCCU GUUUCGCU | 1409 | ACAGGCAAACG GAG |
| hsa-miR-1469 MIMAT0007347 | 1410 | CUCGGCGCGGGGCGCGG GCUCC | 1411 | CUCGGCGCGGGG CGCGGGCU | 1412 | CGCCCCGCGCC GAG |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-146a MIMAT0000449 | 1413 | UGAGAACUGAAUUCCAU GGGUU | 1414 | UGAGAACUGAAU UCCAUGGG | 1415 | GAAUUCAGUUC UCA |
| hsa-miR-146a* MIMAT0004608 | 1416 | CCUCUGAAAUUCAGUUC UUCAG | 1417 | CCUCUGAAAUUC AGUUCUUC | 1418 | CUGAAUUUCAG AGG |
| hsa-miR-146b-3p MIMAT0004766 | 1419 | UGCCCUGUGGACUCAGU UCUGG | 1420 | UGCCCUGUGGAC UCAGUUCU | 1421 | GAGUCCACAGG GCA |
| hsa-miR-146b-5p MIMAT0002809 | 1422 | UGAGAACUGAAUUCCAU AGGCU | 1423 | UGAGAACUGAAU UCCAUAGG | 1424 | GAAUUCAGUUC UCA |
| hsa-miR-147 MIMAT0000251 | 1425 | GUGUGUGGAAAUGCUUC UGC | 1426 | GUGUGUGGAAAU GCUUCUGC | 1427 | GCAUUUCCACA CAC |
| hsa-miR-1470 MIMAT0007348 | 1428 | GCCCUCCGCCCGUGCAC CCCG | 1429 | GCCCUCCGCCCG UGCACCCC | 1430 | CACGGGCGGAG GGC |
| hsa-miR-1471 MIMAT0007349 | 1431 | GCCCGCGUGUGGAGCCA GGUGU | 1432 | GCCCGCGUGUGG AGCCAGGU | 1433 | CUCCACACGCG GGC |
| hsa-miR-147b MIMAT0004928 | 1434 | GUGUGCGGAAAUGCUUC UGCUA | 1435 | GUGUGCGGAAAU GCUUCUGC | 1436 | GCAUUUCCGCA CAC |
| hsa-miR-148a MIMAT0000243 | 1437 | UCAGUGCACUACAGAAC UUUGU | 1438 | UCAGUGCACUAC AGAACUUU | 1439 | CUGUAGUGCAC UGA |
| hsa-miR-148a* MIMAT0004549 | 1440 | AAAGUUCUGAGACACUC CGACU | 1441 | AAAGUUCUGAGA CACUCCGA | 1442 | UGUCUCAGAAC UUU |
| hsa-miR-148b MIMAT0000759 | 1443 | UCAGUGCAUCACAGAAC UUUGU | 1444 | UCAGUGCAUCAC AGAACUUU | 1445 | CUGUGAUGCAC UGA |
| hsa-miR-148b* MIMAT0004699 | 1446 | AAGUUCUGUUAUACACU CAGGC | 1447 | AAGUUCUGUUAU ACACUCAG | 1448 | GUAUAACAGAA CUU |
| hsa-miR-149 MIMAT0000450 | 1449 | UCUGGCUCCGUGUCUUC ACUCCC | 1450 | UCUGGCUCCGUG UCUUCACU | 1451 | GACACGGAGCC AGA |
| hsa-miR-149* MIMAT0004609 | 1452 | AGGGAGGGACGGGGGCU GUGC | 1453 | AGGGAGGGACGG GGGCUGUG | 1454 | CCCCGUCCCUC CCU |
| hsa-miR-150 MIMAT0000451 | 1455 | UCUCCCAACCCUUGUAC CAGUG | 1456 | UCUCCCAACCCU UGUACCAG | 1457 | CAAGGGUUGGG AGA |
| hsa-miR-150* MIMAT0004610 | 1458 | CUGGUACAGGCCUGGGG GACAG | 1459 | CUGGUACAGGCC UGGGGGAC | 1460 | CAGGCCUGUAC CAG |
| hsa-miR-151-3p MIMAT0000757 | 1461 | CUAGACUGAAGCUCCUU GAGG | 1462 | CUAGACUGAAGC UCCUUGAG | 1463 | GAGCUUCAGUC UAG |
| hsa-miR-151-5p MIMAT0004697 | 1464 | UCGAGGAGCUCACAGUC UAGU | 1465 | UCGAGGAGCUCA CAGUCUAG | 1466 | UGUGAGCUCCU CGA |
| hsa-miR-152 MIMAT0000438 | 1467 | UCAGUGCAUGACAGAAC UUGG | 1468 | UCAGUGCAUGAC AGAACUUG | 1469 | CUGUCAUGCAC UGA |
| hsa-miR-153 MIMAT0000439 | 1470 | UUGCAUAGUCACAAAAG UGAUC | 1471 | UUGCAUAGUCAC AAAAGUGA | 1472 | UUGUGACUAUG CAA |
| hsa-miR-1537 MIMAT0007399 | 1473 | AAACCGUCUAGUUACA GUUGU | 1474 | AAACCGUCUAG UUACAGUU | 1475 | AACUAGACGGU UUU |
| hsa-miR-1538 MIMAT0007400 | 1476 | CGGCCCGGGCUGCUGCU GUUCCU | 1477 | CGGCCCGGGCUG CUGCUGUU | 1478 | AGCAGCCCGGG CCG |
| hsa-miR-1539 MIMAT0007401 | 1479 | UCCUGCGCGUCCCAGAU GCCC | 1480 | UCCUGCGCGUCC CAGAUGCC | 1481 | UGGGACGCGCA GGA |
| hsa-miR-154 MIMAT0000452 | 1482 | UAGGUUAUCCGUGUUGC CUUCG | 1483 | UAGGUUAUCCGU GUUGCCUU | 1484 | ACACGGAUAAC CUA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-154* MIMAT0000453 | 1485 | AAUCAUACACGGUUGAC CUAUU | 1486 | AAUCAUACACGG UUGACCUA | 1487 | AACCGUGUAUG AUU |
| hsa-miR-155 MIMAT0000646 | 1488 | UUAAUGCUAAUCGUGAU AGGGGU | 1489 | UUAAUGCUAAUC GUGAUAGG | 1490 | ACGAUUAGCAU UAA |
| hsa-miR-155* MIMAT0004658 | 1491 | CUCCUACAUAUUAGCAU UAACA | 1492 | CUCCUACAUAUU AGCAUUAA | 1493 | CUAAUAUGUAG GAG |
| hsa-miR-15a MIMAT0000068 | 1494 | UAGCAGCACAUAAUGGU UUGUG | 1495 | UAGCAGCACAUA AUGGUUUG | 1496 | AUUAUGUGCUG CUA |
| hsa-miR-15a* MIMAT0004488 | 1497 | CAGGCCAUAUUGUGCUG CCUCA | 1498 | CAGGCCAUAUUG UGCUGCCU | 1499 | CACAAUAUGGC CUG |
| hsa-miR-15b MIMAT0000417 | 1500 | UAGCAGCACAUCAUGGU UUACA | 1501 | UAGCAGCACAUC AUGGUUUA | 1502 | AUGAUGUGCUG CUA |
| hsa-miR-15b* MIMAT0004586 | 1503 | CGAAUCAUUAUUUGCUG CUCUA | 1504 | CGAAUCAUUAUU UGCUGCUC | 1505 | CAAAUAAUGAU UCG |
| hsa-miR-16 MIMAT0000069 | 1506 | UAGCAGCACGUAAAUAU UGGCG | 1507 | UAGCAGCACGUA AAUAUUGG | 1508 | UUUACGUGCUG CUA |
| hsa-miR-16-1* MIMAT0004489 | 1509 | CCAGUAUUAACUGUGCU GCUGA | 1510 | CCAGUAUUAACU GUGCUGCU | 1511 | ACAGUUAAUAC UGG |
| hsa-miR-16-2* MIMAT0004518 | 1512 | CCAAUAUUACUGUGCUG CUUUA | 1513 | CCAAUAUUACUG UGCUGCUU | 1514 | CACAGUAAUAU UGG |
| hsa-miR-17 MIMAT0000070 | 1515 | CAAAGUGCUUACAGUGC AGGUAG | 1516 | CAAAGUGCUUAC AGUGCAGG | 1517 | CUGUAAGCACU UUG |
| hsa-miR-17* MIMAT0000071 | 1518 | ACUGCAGUGAAGGCACU UGUAG | 1519 | ACUGCAGUGAAG GCACUUGU | 1520 | GCCUUCACUGC AGU |
| hsa-miR-181a MIMAT0000256 | 1521 | AACAUUCAACGCUGUCG GUGAGU | 1522 | AACAUUCAACGC UGUCGGUG | 1523 | CAGCGUUGAAU GUU |
| hsa-miR-181a* MIMAT0000270 | 1524 | ACCAUCGACCGUUGAUU GUACC | 1525 | ACCAUCGACCGU UGAUUGUA | 1526 | CAACGGUCGAU GGU |
| hsa-miR-181a-2* MIMAT0004558 | 1527 | ACCACUGACCGUUGACU GUACC | 1528 | ACCACUGACCGU UGACUGUA | 1529 | CAACGGUCAGU GGU |
| hsa-miR-181b MIMAT0000257 | 1530 | AACAUUCAUUGCUGUCG GUGGGU | 1531 | AACAUUCAUUGC UGUCGGUG | 1532 | CAGCAAUGAAU GUU |
| hsa-miR-181c MIMAT0000258 | 1533 | AACAUUCAACCUGUCGG UGAGU | 1534 | AACAUUCAACCU GUCGGUGA | 1535 | ACAGGUUGAAU GUU |
| hsa-miR-181c* MIMAT0004559 | 1536 | AACCAUCGACCGUUGAG UGGAC | 1537 | AACCAUCGACCG UUGAGUGG | 1538 | AACGGUCGAUG GUU |
| hsa-miR-181d MIMAT0002821 | 1539 | AACAUUCAUUGUUGUCG GUGGGU | 1540 | AACAUUCAUUGU UGUCGGUG | 1541 | CAACAAUGAAU GUU |
| hsa-miR-182 MIMAT0000259 | 1542 | UUUGGCAAUGGUAGAAC UCACACU | 1543 | UUUGGCAAUGGU AGAACUCA | 1544 | CUACCAUUGCC AAA |
| hsa-miR-182* MIMAT0000260 | 1545 | UGGUUCUAGACUUGCCA ACUA | 1546 | UGGUUCUAGACU UGCCAACU | 1547 | CAAGUCUAGAA CCA |
| hsa-miR-1825 MIMAT0006765 | 1548 | UCCAGUGCCCUCCUCUCC | 1549 | UCCAGUGCCCUC CUCUCC | 1550 | AGGAGGGCACU GGA |
| hsa-miR-1827 MIMAT0006767 | 1551 | UGAGGCAGUAGAUUGAAU | 1552 | UGAGGCAGUAGA UUGAAU | 1553 | AAUCUACUGCC UCA |
| hsa-miR-183 MIMAT0000261 | 1554 | UAUGGCACUGGUAGAAU UCACU | 1555 | UAUGGCACUGGU AGAAUUCA | 1556 | CUACCAGUGCC AUA |
| hsa-miR-183* MIMAT0004560 | 1557 | GUGAAUUACCGAAGGGC CAUAA | 1558 | GUGAAUUACCGA AGGGCAU | 1559 | CUUCGGUAAUU CAC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-184 MIMAT0000454 | 1560 | UGGACGGAGAACUGAUA AGGGU | 1561 | UGGACGGAGAAC UGAUAAGG | 1562 | CAGUUCUCCGU CCA |
| hsa-miR-185 MIMAT0000455 | 1563 | UGGAGAGAAAGGCAGUU CCUGA | 1564 | UGGAGAGAAAGG CAGUUCCU | 1565 | UGCCUUUCUCU CCA |
| hsa-miR-185* MIMAT0004611 | 1566 | AGGGGCUGGCUUUCCUC UGGUC | 1567 | AGGGGCUGGCUU UCCUCUGG | 1568 | GAAAGCCAGCC CCU |
| hsa-miR-186 MIMAT0000456 | 1569 | CAAAGAAUUCUCCUUUU GGGCU | 1570 | CAAAGAAUUCUC CUUUUGGG | 1571 | AGGAGAAUUCU UUG |
| hsa-miR-186* MIMAT0004612 | 1572 | GCCCAAAGGUGAAUUUU UUGGG | 1573 | GCCCAAAGGUGA AUUUUUUG | 1574 | AUUCACCUUUG GGC |
| hsa-miR-187 MIMAT0000262 | 1575 | UCGUGUCUUGUGUUGCA GCCGG | 1576 | UCGUGUCUUGUG UUGCAGCC | 1577 | AACACAAGACA CGA |
| hsa-miR-187* MIMAT0004561 | 1578 | GGCUACAACACAGGACC CGGGC | 1579 | GGCUACAACACA GGACCCGG | 1580 | CCUGUGUUGUA GCC |
| hsa-miR-188-3p MIMAT0004613 | 1581 | CUCCCACAUGCAGGGUU UGCA | 1582 | CUCCCACAUGCA GGGUUUGC | 1583 | CCUGCAUGUGG GAG |
| hsa-miR-188-5p MIMAT0000457 | 1584 | CAUCCCUUGCAUGGUGG AGGG | 1585 | CAUCCCUUGCAU GGUGGAGG | 1586 | CCAUGCAAGGG AUG |
| hsa-miR-18a MIMAT0000072 | 1587 | UAAGGUGCAUCUAGUGC AGAUAG | 1588 | UAAGGUGCAUCU AGUGCAGA | 1589 | CUAGAUGCACC UUA |
| hsa-miR-18a* MIMAT0002891 | 1590 | ACUGCCCUAAGUGCUCC UUCUGG | 1591 | ACUGCCCUAAGU GCUCCUUC | 1592 | GCACUUAGGGC AGU |
| hsa-miR-18b MIMAT0001412 | 1593 | UAAGGUGCAUCUAGUGC AGUUAG | 1594 | UAAGGUGCAUCU AGUGCAGU | 1595 | CUAGAUGCACC UUA |
| hsa-miR-18b* MIMAT0004751 | 1596 | UGCCCUAAAUGCCCCUU CUGGC | 1597 | UGCCCUAAAUGC CCCUUCUG | 1598 | GGGCAUUUAGG GCA |
| hsa-miR-190 MIMAT0000458 | 1599 | UGAUAUGUUUGAUAUAU UAGGU | 1600 | UGAUAUGUUUGA UAUAUUAG | 1601 | UAUCAAACAUA UCA |
| hsa-miR-1908 MIMAT0007881 | 1602 | CGGCGGGGACGGCGAUU GGUC | 1603 | CGGCGGGGACGG CGAUUGGU | 1604 | CGCCGUCCCCG CCG |
| hsa-miR-1909 MIMAT0007883 | 1605 | CGCAGGGGCCGGGUGCU CACCG | 1606 | CGCAGGGGCCGG GUGCUCAC | 1607 | ACCCGGCCCCU GCG |
| hsa-miR-1909* MIMAT0007882 | 1608 | UGAGUGCCGGUGCCUGC CCUG | 1609 | UGAGUGCCGGUG CCUGCCCU | 1610 | GGCACCGGCAC UCA |
| hsa-miR-190b MIMAT0004929 | 1611 | UGAUAUGUUUGAUAUUG GGUU | 1612 | UGAUAUGUUUGA UAUUGGGU | 1613 | UAUCAAACAUA UCA |
| hsa-miR-191 MIMAT0000440 | 1614 | CAACGGAAUCCCAAAAG CAGCUG | 1615 | CAACGGAAUCCC AAAAGCAG | 1616 | UUGGGAUUCCG UUG |
| hsa-miR-191* MIMAT0001618 | 1617 | GCUGCGCUUGGAUUUCG UCCCC | 1618 | GCUGCGCUUGGA UUUCGUCC | 1619 | AAUCCAAGCGC AGC |
| hsa-miR-1910 MIMAT0007884 | 1620 | CCAGUCCUGUGCCUGCC GCCU | 1621 | CCAGUCCUGUGC CUGCCGCC | 1622 | AGGCACAGGAC UGG |
| hsa-miR-1911 MIMAT0007885 | 1623 | UGAGUACCGCCAUGUCU GUUGGG | 1624 | UGAGUACCGCCA UGUCUGUU | 1625 | CAUGGCGGUAC UCA |
| hsa-miR-1911* MIMAT0007886 | 1626 | CACCAGGCAUUGUGGUC UCC | 1627 | CACCAGGCAUUG UGGUCUCC | 1628 | CACAAUGCCUG GUG |
| hsa-miR-1912 MIMAT0007887 | 1629 | UACCAGAGCAUGCAGU GUGAA | 1630 | UACCAGAGCAU GCAGUGUG | 1631 | GCAUGCUCUGG GUA |
| hsa-miR-1913 MIMAT0007888 | 1632 | UCUGCCCCCUCCGCUGC UGCCA | 1633 | UCUGCCCCCUCC GCUGCUGC | 1634 | GCGGAGGGGC AGA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-1914 MIMAT0007889 | 1635 | CCCUGUGCCCGGCCCAC UUCUG | 1636 | CCCUGUGCCCGG CCCACUUC | 1637 | GGCCGGGCACA GGG |
| hsa-miR-1914* MIMAT0007890 | 1638 | GGAGGGGUCCCGCACUG GGAGG | 1639 | GGAGGGGUCCCG CACUGGGA | 1640 | UGCGGGACCCC UCC |
| hsa-miR-1915 MIMAT0007892 | 1641 | CCCCAGGGCGACGCGGC GGG | 1642 | CCCCAGGGCGAC GCGGCGGG | 1643 | GCGUCGCCCUG GGG |
| hsa-miR-1915* MIMAT0007891 | 1644 | ACCUUGCCUUGCUGCCC GGGCC | 1645 | ACCUUGCCUUGC UGCCCGGG | 1646 | CAGCAAGGCAA GGU |
| hsa-miR-192 MIMAT0000222 | 1647 | CUGACCUAUGAAUUGAC AGCC | 1648 | CUGACCUAUGAA UUGACAGC | 1649 | AAUUCAUAGGU CAG |
| hsa-miR-192* MIMAT0004543 | 1650 | CUGCCAAUUCCAUAGGU CACAG | 1651 | CUGCCAAUUCCA UAGGUCAC | 1652 | UAUGGAAUUGG CAG |
| hsa-miR-193a-3p MIMAT0000459 | 1653 | AACUGGCCUACAAAGUC CCAGU | 1654 | AACUGGCCUACA AAGUCCCA | 1655 | UUUGUAGGCCA GUU |
| hsa-miR-193a-5p MIMAT0004614 | 1656 | UGGGUCUUUGCGGGCGA GAUGA | 1657 | UGGGUCUUUGCG GGCGAGAU | 1658 | CCCGCAAAGAC CCA |
| hsa-miR-193b MIMAT0002819 | 1659 | AACUGGCCCUCAAAGUC CCGCU | 1660 | AACUGGCCCUCA AAGUCCCG | 1661 | UUUGAGGGCCA GUU |
| hsa-miR-193b* MIMAT0004767 | 1662 | CGGGGUUUUGAGGGCGA GAUGA | 1663 | CGGGGUUUUGAG GGCGAGAU | 1664 | CCCUCAAAACC CCG |
| hsa-miR-194 MIMAT0000460 | 1665 | UGUAACAGCAACUCCAU GUGGA | 1666 | UGUAACAGCAAC UCCAUGUG | 1667 | GAGUUGCUGUU ACA |
| hsa-miR-194* MIMAT0004671 | 1668 | CCAGUGGGGCUGCUGUU AUCUG | 1669 | CCAGUGGGGCUG CUGUUAUC | 1670 | AGCAGCCCCAC UGG |
| hsa-miR-195 MIMAT0000461 | 1671 | UAGCAGCACAGAAAUAU UGGC | 1672 | UAGCAGCACAGA AAUAUUGG | 1673 | UUUCUGUGCUG CUA |
| hsa-miR-195* MIMAT0004615 | 1674 | CCAAUAUUGGCUGUGCU GCUCC | 1675 | CCAAUAUUGGCU GUGCUGCU | 1676 | ACAGCCAAUAU UGG |
| hsa-miR-196a MIMAT0000226 | 1677 | UAGGUAGUUUCAUGUUG UUGGG | 1678 | UAGGUAGUUUCA UGUUGUUG | 1679 | CAUGAAACUAC CUA |
| hsa-miR-196a* MIMAT0004562 | 1680 | CGGCAACAAGAAACUGC CUGAG | 1681 | CGGCAACAAGAA ACUGCCUG | 1682 | GUUUCUUGUUG CCG |
| hsa-miR-196b MIMAT0001080 | 1683 | UAGGUAGUUUCCUGUUG UUGGG | 1684 | UAGGUAGUUUCC UGUUGUUG | 1685 | CAGGAAACUAC CUA |
| hsa-miR-196b* MIMAT0009201 | 1686 | UCGACAGCACGACACUG CCUUC | 1687 | UCGACAGCACGA CACUGCCU | 1688 | UGUCGUGCUGU CGA |
| hsa-miR-197 MIMAT0000227 | 1689 | UUCACCACCUUCUCCAC CCAGC | 1690 | UUCACCACCUUC UCCACCCA | 1691 | GAGAAGGUGGU GAA |
| hsa-miR-1972 MIMAT0009447 | 1692 | UCAGGCCAGGCACAGUG GCUCA | 1693 | UCAGGCCAGGCA CAGUGGCU | 1694 | UGUGCCUGGCC UGA |
| hsa-miR-1973 MIMAT0009448 | 1695 | ACCGUGCAAAGGUAGCA UA | 1696 | ACCGUGCAAAGG UAGCAUA | 1697 | UACCUUUGCAC GGU |
| hsa-miR-1976 MIMAT0009451 | 1698 | CCUCCUGCCCUCCUUGC UGU | 1699 | CCUCCUGCCCUC CUUGCUGU | 1700 | AGGAGGGCAGG AGG |
| hsa-miR-198 MIMAT0000228 | 1701 | GGUCCAGAGGGGAGAUA GGUUC | 1702 | GGUCCAGAGGGG AGAUAGGU | 1703 | CUCCCCUCUGG ACC |
| hsa-miR-199a-3p MIMAT0000232 | 1704 | ACAGUAGUCUGCACAUU GGUUA | 1705 | ACAGUAGUCUGC ACAUUGGU | 1706 | GUGCAGACUAC UGU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-199a-5p MIMAT0000231 | 1707 | CCCAGUGUUCAGACUAC CUGUUC | 1708 | CCCAGUGUUCAG ACUACCUG | 1709 | GUCUGAACACU GGG |
| hsa-miR-199b-3p MIMAT0004563 | 1710 | ACAGUAGUCUGCACAUU GGUUA | 1711 | ACAGUAGUCUGC ACAUUGGU | 1712 | GUGCAGACUAC UGU |
| hsa-miR-199b-5p MIMAT0000263 | 1713 | CCCAGUGUUUAGACUAU CUGUUC | 1714 | CCCAGUGUUUAG ACUAUCUG | 1715 | GUCUAAACACU GGG |
| hsa-miR-19a MIMAT0000073 | 1716 | UGUGCAAAUCUAUGCAA AACUGA | 1717 | UGUGCAAAUCUA UGCAAAAC | 1718 | CAUAGAUUUGC ACA |
| hsa-miR-19a* MIMAT0004490 | 1719 | AGUUUUGCAUAGUUGCA CUACA | 1720 | AGUUUUGCAUAG UUGCACUA | 1721 | AACUAUGCAAA ACU |
| hsa-miR-19b MIMAT0000074 | 1722 | UGUGCAAAUCCAUGCAA AACUGA | 1723 | UGUGCAAAUCCA UGCAAAAC | 1724 | CAUGGAUUUGC ACA |
| hsa-miR-19b-1* MIMAT0004491 | 1725 | AGUUUUGCAGGUUUGCA UCCAGC | 1726 | AGUUUUGCAGGU UUGCAUCC | 1727 | AAACCUGCAAA ACU |
| hsa-miR-19b-2* MIMAT0004492 | 1728 | AGUUUUGCAGGUUUGCA UUUCA | 1729 | AGUUUUGCAGGU UUGCAUUU | 1730 | AAACCUGCAAA ACU |
| hsa-miR-200a MIMAT0000682 | 1731 | UAACACUGUCUGGUAAC GAUGU | 1732 | UAACACUGUCUG GUAACGAU | 1733 | ACCAGACAGUG UUA |
| hsa-miR-200a* MIMAT0001620 | 1734 | CAUCUUACCGGACAGUG CUGGA | 1735 | CAUCUUACCGGA CAGUGCUG | 1736 | UGUCCGGUAAG AUG |
| hsa-miR-200b MIMAT0000318 | 1737 | UAAUACUGCCUGGUAAU GAUGA | 1738 | UAAUACUGCCUG GUAAUGAU | 1739 | ACCAGGCAGUA UUA |
| hsa-miR-200b* MIMAT0004571 | 1740 | CAUCUUACUGGGCAGCA UUGGA | 1741 | CAUCUUACUGGG CAGCAUUG | 1742 | UGCCCAGUAAG AUG |
| hsa-miR-200c MIMAT0000617 | 1743 | UAAUACUGCCGGGUAAU GAUGGA | 1744 | UAAUACUGCCGG GUAAUGAU | 1745 | ACCCGGCAGUA UUA |
| hsa-miR-200c* MIMAT0004657 | 1746 | CGUCUUACCCAGCAGUG UUUGG | 1747 | CGUCUUACCCAG CAGUGUUU | 1748 | UGCUGGGUAAG ACG |
| hsa-miR-202 MIMAT0002811 | 1749 | AGAGGUAUAGGGCAUGG GAA | 1750 | AGAGGUAUAGGG CAUGGGAA | 1751 | UGCCCUAUACC UCU |
| hsa-miR-202* MIMAT0002810 | 1752 | UUCCUAUGCAUAUACUU CUUUG | 1753 | UUCCUAUGCAUA UACUUCUU | 1754 | UAUAUGCAUAG GAA |
| hsa-miR-203 MIMAT0000264 | 1755 | GUGAAAUGUUUAGGACC ACUAG | 1756 | GUGAAAUGUUUA GGACCACU | 1757 | CCUAAACAUUU CAC |
| hsa-miR-204 MIMAT0000265 | 1758 | UUCCCUUUGUCAUCCUA UGCCU | 1759 | UUCCCUUUGUCA UCCUAUGC | 1760 | GAUGACAAAGG GAA |
| hsa-miR-205 MIMAT0000266 | 1761 | UCCUUCAUUCCACCGGA GUCUG | 1762 | UCCUUCAUUCCA CCGGAGUC | 1763 | GGUGGAAUGAA GGA |
| hsa-miR-205* MIMAT0009197 | 1764 | GAUUUCAGUGGAGUGAA GUUC | 1765 | GAUUUCAGUGGA GUGAAGUU | 1766 | ACUCCACUGAA AUC |
| hsa-miR-2052 MIMAT0009977 | 1767 | UGUUUUGAUAACAGUAA UGU | 1768 | UGUUUUGAUAAC AGUAAUGU | 1769 | CUGUUAUCAAA ACA |
| hsa-miR-2053 MIMAT0009978 | 1770 | GUGUUAAUUAAACCUCU AUUUAC | 1771 | GUGUUAAUUAAA CCUCUAUU | 1772 | GGUUUAAUUAA CAC |
| hsa-miR-2054 MIMAT0009979 | 1773 | CUGUAAUAUAAAUUUAA UUUAUU | 1774 | CUGUAAUAUAAA UUUAAUUU | 1775 | AAUUUAUAUUA CAG |
| hsa-miR-206 MIMAT0000462 | 1776 | UGGAAUGUAAGGAAGUG UGUGG | 1777 | UGGAAUGUAAGG AAGUGUGU | 1778 | UUCCUUACAUU CCA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-208a MIMAT0000241 | 1779 | AUAAGACGAGCAAAAAG CUUGU | 1780 | AUAAGACGAGCA AAAAGCUU | 1781 | UUUGCUCGUCU UAU |
| hsa-miR-208b MIMAT0004960 | 1782 | AUAAGACGAACAAAAGG UUUGU | 1783 | AUAAGACGAACA AAAGGUUU | 1784 | UUUGUUCGUCU UAU |
| hsa-miR-20a MIMAT0000075 | 1785 | UAAAGUGCUUAUAGUGC AGGUAG | 1786 | UAAAGUGCUUAU AGUGCAGG | 1787 | CUAUAAGCACU UUA |
| hsa-miR-20a* MIMAT0004493 | 1788 | ACUGCAUUAUGAGCACU UAAAG | 1789 | ACUGCAUUAUGA GCACUUAA | 1790 | GCUCAUAAUGC AGU |
| hsa-miR-20b MIMAT0001413 | 1791 | CAAAGUGCUCAUAGUGC AGGUAG | 1792 | CAAAGUGCUCAU AGUGCAGG | 1793 | CUAUGAGCACU UUG |
| hsa-miR-20b* MIMAT0004752 | 1794 | ACUGUAGUAUGGGCACU UCCAG | 1795 | ACUGUAGUAUGG GCACUUCC | 1796 | GCCCAUACUAC AGU |
| hsa-miR-21 MIMAT0000076 | 1797 | UAGCUUAUCAGACUGAU GUUGA | 1798 | UAGCUUAUCAGA CUGAUGUU | 1799 | AGUCUGAUAAG CUA |
| hsa-miR-21* MIMAT0004494 | 1800 | CAACACCAGUCGAUGGG CUGU | 1801 | CAACACCAGUCG AUGGGCUG | 1802 | AUCGACUGGUG UUG |
| hsa-miR-210 MIMAT0000267 | 1803 | CUGUGCGUGUGACAGCG GCUGA | 1804 | CUGUGCGUGUGA CAGCGGCU | 1805 | UGUCACACGCA CAG |
| hsa-miR-211 MIMAT0000268 | 1806 | UUCCCUUUGUCAUCCUU CGCCU | 1807 | UUCCCUUUGUCA UCCUUCGC | 1808 | GAUGACAAAGG GAA |
| hsa-miR-2110 MIMAT0010133 | 1809 | UUGGGGAAACGGCCGCU GAGUG | 1810 | UUGGGGAAACGG CCGCUGAG | 1811 | GGCCGUUUCCC CAA |
| hsa-miR-2113 MIMAT0009206 | 1812 | AUUUGUGCUUGGCUCUG UCAC | 1813 | AUUUGUGCUUGG CUCUGUCA | 1814 | AGCCAAGCACA AAU |
| hsa-miR-2114 MIMAT0011156 | 1815 | UAGUCCCUUCCUUGAAG CGGUC | 1816 | UAGUCCCUUCCU UGAAGCGG | 1817 | CAAGGAAGGGA CUA |
| hsa-miR-2114* MIMAT0011157 | 1818 | CGAGCCUCAAGCAAGGG ACUU | 1819 | CGAGCCUCAAGC AAGGGACU | 1820 | UUGCUUGAGGC UCG |
| hsa-miR-2115 MIMAT0011158 | 1821 | AGCUUCCAUGACUCCUG AUGGA | 1822 | AGCUUCCAUGAC UCCUGAUG | 1823 | GAGUCAUGGAA GCU |
| hsa-miR-2115* MIMAT0011159 | 1824 | CAUCAGAAUUCAUGGAG GCUAG | 1825 | CAUCAGAAUUCA UGGAGGCU | 1826 | CAUGAAUUCUG AUG |
| hsa-miR-2116 MIMAT0011160 | 1827 | GGUUCUUAGCAUAGGAG GUCU | 1828 | GGUUCUUAGCAU AGGAGGUC | 1829 | CUAUGCUAAGA ACC |
| hsa-miR-2116* MIMAT0011161 | 1830 | CCUCCCAUGCCAAGAAC UCCC | 1831 | CCUCCCAUGCCA AGAACUCC | 1832 | CUUGGCAUGGG AGG |
| hsa-miR-2117 MIMAT0011162 | 1833 | UGUUCUCUUUGCCAAGG ACAG | 1834 | UGUUCUCUUUGC CAAGGACA | 1835 | UGGCAAAGAGA ACA |
| hsa-miR-212 MIMAT0000269 | 1836 | UAACAGUCUCCAGUCAC GGCC | 1837 | UAACAGUCUCCA GUCACGGC | 1838 | ACUGGAGACUG UUA |
| hsa-miR-214 MIMAT0000271 | 1839 | ACAGCAGGCACAGACAG GCAGU | 1840 | ACAGCAGGCACA GACAGGCA | 1841 | UCUGUGCCUGC UGU |
| hsa-miR-214* MIMAT0004564 | 1842 | UGCCUGUCUACACUUGC UGUGC | 1843 | UGCCUGUCUACA CUUGCUGU | 1844 | AGUGUAGACAG GCA |
| hsa-miR-215 MIMAT0000272 | 1845 | AUGACCUAUGAAUUGAC AGAC | 1846 | AUGACCUAUGAA UUGACAGA | 1847 | AAUUCAUAGGU CAU |
| hsa-miR-216a MIMAT0000273 | 1848 | UAAUCUCAGCUGGCAAC UGUGA | 1849 | UAAUCUCAGCUG GCAACUGU | 1850 | GCCAGCUGAGA UUA |
| hsa-miR-216b MIMAT0004959 | 1851 | AAAUCUCUGCAGGCAAA UGUGA | 1852 | AAAUCUCUGCAG GCAAAUGU | 1853 | GCCUGCAGAGA UUU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-217 MIMAT0000274 | 1854 | UACUGCAUCAGGAACUGAUUGGA | 1855 | UACUGCAUCAGGAACUGAUU | 1856 | UUCCUGAUGCAGUA |
| hsa-miR-218 MIMAT0000275 | 1857 | UUGUGCUUGAUCUAACCAUGU | 1858 | UUGUGCUUGAUCUAACCAUG | 1859 | UAGAUCAAGCACAA |
| hsa-miR-218-1* MIMAT0004565 | 1860 | AUGGUUCCGUCAAGCACCAUGG | 1861 | AUGGUUCCGUCAAGCACCAU | 1862 | CUUGACGGAACCAU |
| hsa-miR-218-2* MIMAT0004566 | 1863 | CAUGGUUCUGUCAAGCACCGCG | 1864 | CAUGGUUCUGUCAAGCACCG | 1865 | UUGACAGAACCAUG |
| hsa-miR-219-1-3p MIMAT0004567 | 1866 | AGAGUUGAGUCUGGACGUCCCG | 1867 | AGAGUUGAGUCUGGACGUCC | 1868 | CCAGACUCAACUCU |
| hsa-miR-219-2-3p MIMAT0004675 | 1869 | AGAAUUGUGGCUGGACAUCUGU | 1870 | AGAAUUGUGGCUGGACAUCU | 1871 | CCAGCCACAAUUCU |
| hsa-miR-219-5p MIMAT0000276 | 1872 | UGAUUGUCCAAACGCAAUUCU | 1873 | UGAUUGUCCAAACGCAAUUC | 1874 | CGUUUGGACAAUCA |
| hsa-miR-22 MIMAT0000077 | 1875 | AAGCUGCCAGUUGAAGAACUGU | 1876 | AAGCUGCCAGUUGAAGAACU | 1877 | UCAACUGGCAGCUU |
| hsa-miR-22* MIMAT0004495 | 1878 | AGUUCUUCAGUGGCAAGCUUUA | 1879 | AGUUCUUCAGUGGCAAGCUU | 1880 | GCCACUGAAGAACU |
| hsa-miR-221 MIMAT0000278 | 1881 | AGCUACAUUGUCUGCUGGGUUUC | 1882 | AGCUACAUUGUCUGCUGGGU | 1883 | CAGACAAUGUAGCU |
| hsa-miR-221* MIMAT0004568 | 1884 | ACCUGGCAUACAAUGUAGAUUU | 1885 | ACCUGGCAUACAAUGUAGAU | 1886 | AUUGUAUGCCAGGU |
| hsa-miR-222 MIMAT0000279 | 1887 | AGCUACAUCUGGCUACUGGGU | 1888 | AGCUACAUCUGGCUACUGGG | 1889 | AGCCAGAUGUAGCU |
| hsa-miR-222* MIMAT0004569 | 1890 | CUCAGUAGCCAGUGUAGAUCCU | 1891 | CUCAGUAGCCAGUGUAGAUC | 1892 | CACUGGCUACUGAG |
| hsa-miR-223 MIMAT0000280 | 1893 | UGUCAGUUUGUCAAAUACCCCA | 1894 | UGUCAGUUUGUCAAAUACCC | 1895 | UUGACAAACUGACA |
| hsa-miR-223* MIMAT0004570 | 1896 | CGUGUAUUUGACAAGCUGAGUU | 1897 | CGUGUAUUUGACAAGCUGAG | 1898 | UUGUCAAAUACACG |
| hsa-miR-224 MIMAT0000281 | 1899 | CAAGUCACUAGUGGUUCCGUU | 1900 | CAAGUCACUAGUGGUUCCGU | 1901 | CCACUAGUGACUUG |
| hsa-miR-224* MIMAT0009198 | 1902 | AAAAUGGUGCCCUAGUGACUACA | 1903 | AAAAUGGUGCCCUAGUGACU | 1904 | UAGGGCACCAUUUU |
| hsa-miR-2276 MIMAT0011775 | 1905 | UCUGCAAGUGUCAGAGGCGAGG | 1906 | UCUGCAAGUGUCAGAGGCGA | 1907 | CUGACACUUGCAGA |
| hsa-miR-2277-3p MIMAT0011777 | 1908 | UGACAGCGCCCUGCCUGGCUC | 1909 | UGACAGCGCCCUGCCUGGCU | 1910 | GCAGGGCGCUGUCA |
| hsa-miR-2277-5p MIMAT0017352 | 1911 | AGCGCGGGCUGAGCGCUGCCAGUC | 1912 | AGCGCGGGCUGAGCGCUGCC | 1913 | GCUCAGCCCGCGCU |
| hsa-miR-2278 MIMAT0011778 | 1914 | GAGAGCAGUGUGUGUUGCCUGG | 1915 | GAGAGCAGUGUGUGUUGCCU | 1916 | CACACACUGCUCUC |
| hsa-miR-2355-3p MIMAT0017950 | 1917 | AUUGUCCUUGCUGUUUGGAGAU | 1918 | AUUGUCCUUGCUGUUUGGAG | 1919 | ACAGCAAGGACAAU |
| hsa-miR-2355-5p MIMAT0016895 | 1920 | AUCCCCAGAUACAAUGGACAA | 1921 | AUCCCCAGAUACAAUGGACA | 1922 | UUGUAUCUGGGGAU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-23a MIMAT0000078 | 1923 | AUCACAUUGCCAGGGAUUUCC | 1924 | AUCACAUUGCCAGGGAUUUC | 1925 | CCUGGCAAUGUGAU |
| hsa-miR-23a* MIMAT0004496 | 1926 | GGGGUUCCUGGGGAUGGGAUUU | 1927 | GGGGUUCCUGGGGAUGGGAU | 1928 | UCCCCAGGAACCCC |
| hsa-miR-23b MIMAT0000418 | 1929 | AUCACAUUGCCAGGGAUUACC | 1930 | AUCACAUUGCCAGGGAUUAC | 1931 | CCUGGCAAUGUGAU |
| hsa-miR-23b* MIMAT0004587 | 1932 | UGGGUUCCUGGCAUGCUGAUUU | 1933 | UGGGUUCCUGGCAUGCUGAU | 1934 | AUGCCAGGAACCCA |
| hsa-miR-23c MIMAT0018000 | 1935 | AUCACAUUGCCAGUGAUUACCC | 1936 | AUCACAUUGCCAGUGAUUAC | 1937 | ACUGGCAAUGUGAU |
| hsa-miR-24 MIMAT0000080 | 1938 | UGGCUCAGUUCAGCAGGAACAG | 1939 | UGGCUCAGUUCAGCAGGAAC | 1940 | GCUGAACUGAGCCA |
| hsa-miR-24-1* MIMAT0000079 | 1941 | UGCCUACUGAGCUGAUAUCAGU | 1942 | UGCCUACUGAGCUGAUAUCA | 1943 | CAGCUCAGUAGGCA |
| hsa-miR-24-2* MIMAT0004497 | 1944 | UGCCUACUGAGCUGAAACACAG | 1945 | UGCCUACUGAGCUGAAACAC | 1946 | CAGCUCAGUAGGCA |
| hsa-miR-25 MIMAT0000081 | 1947 | CAUUGCACUUGUCUCGGUCUGA | 1948 | CAUUGCACUUGUCUCGGUCU | 1949 | AGACAAGUGCAAUG |
| hsa-miR-25* MIMAT0004498 | 1950 | AGGCGGAGACUUGGGCAAUUG | 1951 | AGGCGGAGACUUGGGCAAUU | 1952 | CCAAGUCUCCGCCU |
| hsa-miR-26a MIMAT0000082 | 1953 | UUCAAGUAAUCCAGGAUAGGCU | 1954 | UUCAAGUAAUCCAGGAUAGG | 1955 | CUGGAUUACUUGAA |
| hsa-miR-26a-1* MIMAT0004499 | 1956 | CCUAUUCUUGGUUACUUGCACG | 1957 | CCUAUUCUUGGUUACUUGCA | 1958 | UAACCAAGAAUAGG |
| hsa-miR-26a-2* MIMAT0004681 | 1959 | CCUAUUCUUGAUUACUUGUUUC | 1960 | CCUAUUCUUGAUUACUUGUU | 1961 | UAAUCAAGAAUAGG |
| hsa-miR-26b MIMAT0000083 | 1962 | UUCAAGUAAUUCAGGAUAGGU | 1963 | UUCAAGUAAUUCAGGAUAGG | 1964 | CUGAAUUACUUGAA |
| hsa-miR-26b* MIMAT0004500 | 1965 | CCUGUUCUCCAUUACUUGGCUC | 1966 | CCUGUUCUCCAUUACUUGGC | 1967 | UAAUGGAGAACAGG |
| hsa-miR-27a MIMAT0000084 | 1968 | UUCACAGUGGCUAAGUUCCGC | 1969 | UUCACAGUGGCUAAGUUCCG | 1970 | UUAGCCACUGUGAA |
| hsa-miR-27a* MIMAT0004501 | 1971 | AGGGCUUAGCUGCUUGUGAGCA | 1972 | AGGGCUUAGCUGCUUGUGAG | 1973 | AGCAGCUAAGCCCU |
| hsa-miR-27b MIMAT0000419 | 1974 | UUCACAGUGGCUAAGUUCUGC | 1975 | UUCACAGUGGCUAAGUUCUG | 1976 | UUAGCCACUGUGAA |
| hsa-miR-27b* MIMAT0004588 | 1977 | AGAGCUUAGCUGAUUGGUGAAC | 1978 | AGAGCUUAGCUGAUUGGUGA | 1979 | AUCAGCUAAGCUCU |
| hsa-miR-28-3p MIMAT0004502 | 1980 | CACUAGAUUGUGAGCUCCUGGA | 1981 | CACUAGAUUGUGAGCUCCUG | 1982 | CUCACAAUCUAGUG |
| hsa-miR-28-5p MIMAT0000085 | 1983 | AAGGAGCUCACAGUCUAUUGAG | 1984 | AAGGAGCUCACAGUCUAUUG | 1985 | ACUGUGAGCUCCUU |
| hsa-miR-2861 MIMAT0013802 | 1986 | GGGGCCUGGCGGUGGGCGG | 1987 | GGGGCCUGGCGGUGGGCGG | 1988 | CACCGCCAGGCCCC |
| hsa-miR-2909 MIMAT0013863 | 1989 | GUUAGGGCCAACAUCUCUUGG | 1990 | GUUAGGGCCAACAUCUCUUG | 1991 | AUGUUGGCCCUAAC |
| hsa-miR-296-3p MIMAT0004679 | 1992 | GAGGGUUGGGUGGAGGCUCUCC | 1993 | GAGGGUUGGGUGGAGGCUCU | 1994 | UCCACCCAACCCUC |
| hsa-miR-296-5p MIMAT0000690 | 1995 | AGGGCCCCCCCUCAAUCCUGU | 1996 | AGGGCCCCCCCUCAAUCCUG | 1997 | UGAGGGGGGGCCCU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-297 MIMAT0004450 | 1998 | AUGUAUGUGUGCAUGUG CAUG | 1999 | AUGUAUGUGUGC AUGUGCAU | 2000 | AUGCACACAUA CAU |
| hsa-miR-298 MIMAT0004901 | 2001 | AGCAGAAGCAGGGAGGU UCUCCCA | 2002 | AGCAGAAGCAGG GAGGUUCU | 2003 | UCCCUGCUUCU GCU |
| hsa-miR-299-3p MIMAT0000687 | 2004 | UAUGUGGGAUGGUAAAC CGCUU | 2005 | UAUGUGGGAUGG UAAACCGC | 2006 | UACCAUCCCAC AUA |
| hsa-miR-299-5p MIMAT0002890 | 2007 | UGGUUUACCGUCCCACA UACAU | 2008 | UGGUUUACCGUC CCACAUAC | 2009 | GGGACGGUAAA CCA |
| hsa-miR-29a MIMAT0000086 | 2010 | UAGCACCAUCUGAAAUC GGUUA | 2011 | UAGCACCAUCUG AAAUCGGU | 2012 | UUCAGAUGGUG CUA |
| hsa-miR-29a* MIMAT0004503 | 2013 | ACUGAUUUCUUUUGGUG UUCAG | 2014 | ACUGAUUUCUUU UGGUGUUC | 2015 | CAAAAGAAAUC AGU |
| hsa-miR-29b MIMAT0000100 | 2016 | UAGCACCAUUUGAAAUC AGUGUU | 2017 | UAGCACCAUUUG AAAUCAGU | 2018 | UUCAAAUGGUG CUA |
| hsa-miR-29b-1* MIMAT0004514 | 2019 | GCUGGUUUCAUAUGGUG GUUUAGA | 2020 | GCUGGUUUCAUA UGGUGGUU | 2021 | CAUAUGAAACC AGC |
| hsa-miR-29b-2* MIMAT0004515 | 2022 | CUGGUUUCACAUGGUGG CUUAG | 2023 | CUGGUUUCACAU GGUGGCUU | 2024 | CCAUGUGAAAC CAG |
| hsa-miR-29c MIMAT0000681 | 2025 | UAGCACCAUUUGAAAUC GGUUA | 2026 | UAGCACCAUUUG AAAUCGGU | 2027 | UUCAAAUGGUG CUA |
| hsa-miR-29c* MIMAT0004673 | 2028 | UGACCGAUUUCUCCUGG UGUUC | 2029 | UGACCGAUUUCU CCUGGUGU | 2030 | GGAGAAAUCGG UCA |
| hsa-miR-300 MIMAT0004903 | 2031 | UAUACAAGGGCAGACUC UCUCU | 2032 | UAUACAAGGGCA GACUCUCU | 2033 | UCUGCCCUUGU AUA |
| hsa-miR-301a MIMAT0000688 | 2034 | CAGUGCAAUAGUAUUGU CAAAGC | 2035 | CAGUGCAAUAGU AUUGUCAA | 2036 | AUACUAUUGCA CUG |
| hsa-miR-301b MIMAT0004958 | 2037 | CAGUGCAAUGAUAUUGU CAAAGC | 2038 | CAGUGCAAUGAU AUUGUCAA | 2039 | AUAUCAUUGCA CUG |
| hsa-miR-302a MIMAT0000684 | 2040 | UAAGUGCUUCCAUGUUU UGGUGA | 2041 | UAAGUGCUUCCA UGUUUUGG | 2042 | CAUGGAAGCAC UUA |
| hsa-miR-302a* MIMAT0000683 | 2043 | ACUUAAACGUGGAUGUA CUUGCU | 2044 | ACUUAAACGUGG AUGUACUU | 2045 | AUCCACGUUUA AGU |
| hsa-miR-302b MIMAT0000715 | 2046 | UAAGUGCUUCCAUGUUU UAGUAG | 2047 | UAAGUGCUUCCA UGUUUUAG | 2048 | CAUGGAAGCAC UUA |
| hsa-miR-302b* MIMAT0000714 | 2049 | ACUUUAACAUGGAAGUG CUUUC | 2050 | ACUUUAACAUGG AAGUGCUU | 2051 | UUCCAUGUUAA AGU |
| hsa-miR-302c MIMAT0000717 | 2052 | UAAGUGCUUCCAUGUUU CAGUGG | 2053 | UAAGUGCUUCCA UGUUUCAG | 2054 | CAUGGAAGCAC UUA |
| hsa-miR-302c* MIMAT0000716 | 2055 | UUUAACAUGGGGGUACC UGCUG | 2056 | UUUAACAUGGGG GUACCUGC | 2057 | ACCCCAUGUU AAA |
| hsa-miR-302d MIMAT0000718 | 2058 | UAAGUGCUUCCAUGUUU GAGUGU | 2059 | UAAGUGCUUCCA UGUUUGAG | 2060 | CAUGGAAGCAC UUA |
| hsa-miR-302d* MIMAT0004685 | 2061 | ACUUUAACAUGGAGGCA CUUGC | 2062 | ACUUUAACAUGG AGGCACUU | 2063 | CUCCAUGUUAA AGU |
| hsa-miR-302e MIMAT0005931 | 2064 | UAAGUGCUUCCAUGCUU | 2065 | UAAGUGCUUCCA UGCUU | 2066 | CAUGGAAGCAC UUA |
| hsa-miR-302f MIMAT0005932 | 2067 | UAAUUGCUUCCAUGUUU | 2068 | UAAUUGCUUCCA UGUUU | 2069 | CAUGGAAGCAA UUA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3065-3p MIMAT0015378 | 2070 | UCAGCACCAGGAUAUUGUUGGAG | 2071 | UCAGCACCAGGAUAUUGUUG | 2072 | UAUCCUGGUGCUGA |
| hsa-miR-3065-5p MIMAT0015066 | 2073 | UCAACAAAAUCACUGAUGCUGGA | 2074 | UCAACAAAAUCACUGAUGCU | 2075 | AGUGAUUUUGUUGA |
| hsa-miR-3074 MIMAT0015027 | 2076 | GAUAUCAGCUCAGUAGGCACCG | 2077 | GAUAUCAGCUCAGUAGGCAC | 2078 | ACUGAGCUGAUAUC |
| hsa-miR-30a MIMAT0000087 | 2079 | UGUAAACAUCCUCGACUGGAAG | 2080 | UGUAAACAUCCUCGACUGGA | 2081 | CGAGGAUGUUUACA |
| hsa-miR-30a* MIMAT0000088 | 2082 | CUUUCAGUCGGAUGUUUGCAGC | 2083 | CUUUCAGUCGGAUGUUUGCA | 2084 | CAUCCGACUGAAAG |
| hsa-miR-30b MIMAT0000420 | 2085 | UGUAAACAUCCUACACUCAGCU | 2086 | UGUAAACAUCCUACACUCAG | 2087 | GUAGGAUGUUUACA |
| hsa-miR-30b* MIMAT0004589 | 2088 | CUGGGAGGUGGAUGUUUACUUC | 2089 | CUGGGAGGUGGAUGUUUACU | 2090 | CAUCCACCUCCCAG |
| hsa-miR-30c MIMAT0000244 | 2091 | UGUAAACAUCCUACACUCUCAGC | 2092 | UGUAAACAUCCUACACUCUC | 2093 | GUAGGAUGUUUACA |
| hsa-miR-30c-1* MIMAT0004674 | 2094 | CUGGGAGAGGGUUGUUUACUCC | 2095 | CUGGGAGAGGGUUGUUUACU | 2096 | CAACCCUCUCCCAG |
| hsa-miR-30c-2* MIMAT0004550 | 2097 | CUGGGAGAAGGCUGUUUACUCU | 2098 | CUGGGAGAAGGCUGUUUACU | 2099 | CAGCCUUCUCCCAG |
| hsa-miR-30d MIMAT0000245 | 2100 | UGUAAACAUCCCCGACUGGAAG | 2101 | UGUAAACAUCCCCGACUGGA | 2102 | CGGGGAUGUUUACA |
| hsa-miR-30d* MIMAT0004551 | 2103 | CUUUCAGUCAGAUGUUUGCUGC | 2104 | CUUUCAGUCAGAUGUUUGCU | 2105 | CAUCUGACUGAAAG |
| hsa-miR-30e MIMAT0000692 | 2106 | UGUAAACAUCCUUGACUGGAAG | 2107 | UGUAAACAUCCUUGACUGGA | 2108 | CAAGGAUGUUUACA |
| hsa-miR-30e* MIMAT0000693 | 2109 | CUUUCAGUCGGAUGUUUACAGC | 2110 | CUUUCAGUCGGAUGUUUACA | 2111 | CAUCCGACUGAAAG |
| hsa-miR-31 MIMAT0000089 | 2112 | AGGCAAGAUGCUGGCAUAGCU | 2113 | AGGCAAGAUGCUGGCAUAGC | 2114 | CCAGCAUCUUGCCU |
| hsa-miR-31* MIMAT0004504 | 2115 | UGCUAUGCCAACAUAUUGCCAU | 2116 | UGCUAUGCCAACAUAUUGCC | 2117 | AUGUUGGCAUAGCA |
| hsa-miR-3115 MIMAT0014977 | 2118 | AUAUGGGUUUACUAGUUGGU | 2119 | AUAUGGGUUUACUAGUUGGU | 2120 | UAGUAAACCCAUAU |
| hsa-miR-3116 MIMAT0014978 | 2121 | UGCCUGGAACAUAGUAGGGACU | 2122 | UGCCUGGAACAUAGUAGGGA | 2123 | CUAUGUUCCAGGCA |
| hsa-miR-3117 MIMAT0014979 | 2124 | AUAGGACUCAUAUAGUGCCAG | 2125 | AUAGGACUCAUAUAGUGCCA | 2126 | UAUAUGAGUCCUAU |
| hsa-miR-3118 MIMAT0014980 | 2127 | UGUGACUGCAUUAUGAAAAUUCU | 2128 | UGUGACUGCAUUAUGAAAAU | 2129 | AUAAUGCAGUCACA |
| hsa-miR-3119 MIMAT0014981 | 2130 | UGGCUUUUAACUUUGAUGGC | 2131 | UGGCUUUUAACUUUGAUGGC | 2132 | AAAGUUAAAAGCCA |
| hsa-miR-3120 MIMAT0014982 | 2133 | CACAGCAAGUGUAGACAGGCA | 2134 | CACAGCAAGUGUAGACAGGC | 2135 | CUACACUUGCUGUG |
| hsa-miR-3121 MIMAT0014983 | 2136 | UAAAUAGAGUAGGCAAAGGACA | 2137 | UAAAUAGAGUAGGCAAAGGA | 2138 | GCCUACUCUAUUUA |
| hsa-miR-3122 MIMAT0014984 | 2139 | GUUGGGACAAGAGGACGUCUU | 2140 | GUUGGGACAAGAGGACGGUC | 2141 | CCUCUUGUCCCAAC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3123 MIMAT0014985 | 2142 | CAGAGAAUUGUUUAAUC | 2143 | CAGAGAAUUGUU UAAUC | 2144 | UAAACAAUUCU CUG |
| hsa-miR-3124 MIMAT0014986 | 2145 | UUCGCGGGCGAAGGCAA AGUC | 2146 | UUCGCGGGCGAA GGCAAAGU | 2147 | CCUUCGCCCGC GAA |
| hsa-miR-3125 MIMAT0014988 | 2148 | UAGAGGAAGCUGUGGAG AGA | 2149 | UAGAGGAAGCUG UGGAGAGA | 2150 | CACAGCUUCCU CUA |
| hsa-miR-3126-3p MIMAT0015377 | 2151 | CAUCUGGCAUCCGUCAC ACAGA | 2152 | CAUCUGGCAUCC GUCACACA | 2153 | ACGGAUGCCAG AUG |
| hsa-miR-3126-5p MIMAT0014989 | 2154 | UGAGGGACAGAUGCCAG AAGCA | 2155 | UGAGGGACAGAU GCCAGAAG | 2156 | GCAUCUGUCCC UCA |
| hsa-miR-3127 MIMAT0014990 | 2157 | AUCAGGGCUUGUGGAAU GGGAAG | 2158 | AUCAGGGCUUGU GGAAUGGG | 2159 | CCACAAGCCCU GAU |
| hsa-miR-3128 MIMAT0014991 | 2160 | UCUGGCAAGUAAAAAAC UCUCAU | 2161 | UCUGGCAAGUAA AAAACUCU | 2162 | UUUUACUUGCC AGA |
| hsa-miR-3129 MIMAT0014992 | 2163 | GCAGUAGUGUAGAGAUU GGUUU | 2164 | GCAGUAGUGUAG AGAUUGGU | 2165 | CUCUACACUAC UGC |
| hsa-miR-3130-3p MIMAT0014994 | 2166 | GCUGCACCGGAGACUGG GUAA | 2167 | GCUGCACCGGAG ACUGGGUA | 2168 | GUCUCCGGUGC AGC |
| hsa-miR-3130-5p MIMAT0014995 | 2169 | UACCCAGUCUCCGGUGC AGCC | 2170 | UACCCAGUCUCC GGUGCAGC | 2171 | CCGGAGACUGG GUA |
| hsa-miR-3131 MIMAT0014996 | 2172 | UCGAGGACUGGUGGAAG GGCCUU | 2173 | UCGAGGACUGGU GGAAGGGC | 2174 | CCACCAGUCCU CGA |
| hsa-miR-3132 MIMAT0014997 | 2175 | UGGGUAGAGAAGGAGCU CAGAGGA | 2176 | UGGGUAGAGAAG GAGCUCAG | 2177 | UCCUUCUCUAC CCA |
| hsa-miR-3133 MIMAT0014998 | 2178 | UAAAGAACUCUUAAAAC CCAAU | 2179 | UAAAGAACUCUU AAAACCCA | 2180 | UUAAGAGUUCU UUA |
| hsa-miR-3134 MIMAT0015000 | 2181 | UGAUGGAUAAAAGACUA CAUAUU | 2182 | UGAUGGAUAAAA GACUACAU | 2183 | UCUUUUAUCCA UCA |
| hsa-miR-3135 MIMAT0015001 | 2184 | UGCCUAGGCUGAGACUG CAGUG | 2185 | UGCCUAGGCUGA GACUGCAG | 2186 | UCUCAGCCUAG GCA |
| hsa-miR-3136 MIMAT0015003 | 2187 | CUGACUGAAUAGGUAGG GUCAUU | 2188 | CUGACUGAAUAG GUAGGGUC | 2189 | ACCUAUUCAGU CAG |
| hsa-miR-3137 MIMAT0015005 | 2190 | UCUGUAGCCUGGGAGCA AUGGGGU | 2191 | UCUGUAGCCUGG GAGCAAUG | 2192 | UCCCAGGCUAC AGA |
| hsa-miR-3138 MIMAT0015006 | 2193 | UGUGGACAGUGAGGUAG AGGGAGU | 2194 | UGUGGACAGUGA GGUAGAGG | 2195 | CCUCACUGUCC ACA |
| hsa-miR-3139 MIMAT0015007 | 2196 | UAGGAGCUCAACAGAUG CCUGUU | 2197 | UAGGAGCUCAAC AGAUGCCU | 2198 | CUGUUGAGCUC CUA |
| hsa-miR-3140 MIMAT0015008 | 2199 | AGCUUUGGGAAUUCAG GUAGU | 2200 | AGCUUUGGGAA UUCAGGUA | 2201 | AAUUCCCAAAA GCU |
| hsa-miR-3141 MIMAT0015010 | 2202 | GAGGGCGGGUGGAGGAG GA | 2203 | GAGGGCGGGUGG AGGAGGA | 2204 | CUCCACCCGCC CUC |
| hsa-miR-3142 MIMAT0015011 | 2205 | AAGGCCUUUCUGAACCU UCAGA | 2206 | AAGGCCUUUCUG AACCUUCA | 2207 | UUCAGAAAGGC CUU |
| hsa-miR-3143 MIMAT0015012 | 2208 | AUAACAUUGUAAAGCGC UUCUUUCG | 2209 | AUAACAUUGUAA AGCGCUUC | 2210 | CUUUACAAUGU UAU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3144-3p MIMAT0015015 | 2211 | AUAUACCUGUUCGGUCU CUUUA | 2212 | AUAUACCUGUUC GGUCUCUU | 2213 | CCGAACAGGUA UAU |
| hsa-miR-3144-5p MIMAT0015014 | 2214 | AGGGGACCAAAGAGAUA UAUAG | 2215 | AGGGGACCAAAG AGAUAUAU | 2216 | CUCUUUGGUCC CCU |
| hsa-miR-3145 MIMAT0015016 | 2217 | AGAUAUUUUGAGUGUUU GGAAUUG | 2218 | AGAUAUUUUGAG UGUUUGGA | 2219 | CACUCAAAAUA UCU |
| hsa-miR-3146 MIMAT0015018 | 2220 | CAUGCUAGGAUAGAAAG AAUGG | 2221 | CAUGCUAGGAUA GAAAGAAU | 2222 | UCUAUCCUAGC AUG |
| hsa-miR-3147 MIMAT0015019 | 2223 | GGUUGGGCAGUGAGGAG GGUGUGA | 2224 | GGUUGGGCAGUG AGGAGGGU | 2225 | CUCACUGCCCA ACC |
| hsa-miR-3148 MIMAT0015021 | 2226 | UGGAAAAACUGGUGUG UGCUU | 2227 | UGGAAAAACUG GUGUGUGC | 2228 | ACCAGUUUUUU CCA |
| hsa-miR-3149 MIMAT0015022 | 2229 | UUUGUAUGGAUAUGUGU GUGUAU | 2230 | UUUGUAUGGAUA UGUGUGUG | 2231 | CAUAUCCAUAC AAA |
| hsa-miR-3150 MIMAT0015023 | 2232 | CUGGGGAGAUCCUCGAG GUUGG | 2233 | CUGGGGAGAUCC UCGAGGUU | 2234 | GAGGAUCUCCC CAG |
| hsa-miR-3150b MIMAT0018194 | 2235 | UGAGGAGAUCGUCGAGG UUGG | 2236 | UGAGGAGAUCGU CGAGGUUG | 2237 | CGACGAUCUCC UCA |
| hsa-miR-3151 MIMAT0015024 | 2238 | GGUGGGGCAAUGGGAUC AGGU | 2239 | GGUGGGGCAAUG GGAUCAGG | 2240 | CCCAUUGCCCC ACC |
| hsa-miR-3152 MIMAT0015025 | 2241 | UGUGUUAGAAUAGGGGC AAUAA | 2242 | UGUGUUAGAAUA GGGGCAAU | 2243 | CCUAUUCUAAC ACA |
| hsa-miR-3153 MIMAT0015026 | 2244 | GGGGAAAGCGAGUAGGG ACAUUU | 2245 | GGGGAAAGCGAG UAGGGACA | 2246 | UACUCGCUUUC CCC |
| hsa-miR-3154 MIMAT0015028 | 2247 | CAGAAGGGGAGUUGGGA GCAGA | 2248 | CAGAAGGGGAGU UGGGAGCA | 2249 | CAACUCCCCUU CUG |
| hsa-miR-3155 MIMAT0015029 | 2250 | CCAGGCUCUGCAGUGGG AACU | 2251 | CCAGGCUCUGCA GUGGGAAC | 2252 | ACUGCAGAGCC UGG |
| hsa-miR-3156 MIMAT0015030 | 2253 | AAAGAUCUGGAAGUGGG AGACA | 2254 | AAAGAUCUGGAA GUGGGAGA | 2255 | ACUUCCAGAUC UUU |
| hsa-miR-3157 MIMAT0015031 | 2256 | UUCAGCCAGGCUAGUGC AGUCU | 2257 | UUCAGCCAGGCU AGUGCAGU | 2258 | CUAGCCUGGCU GAA |
| hsa-miR-3158 MIMAT0015032 | 2259 | AAGGGCUUCCUCUCUGC AGGAC | 2260 | AAGGGCUUCCUC UCUGCAGG | 2261 | GAGAGGAAGCC CUU |
| hsa-miR-3159 MIMAT0015033 | 2262 | UAGGAUUACAAGUGUCG GCCAC | 2263 | UAGGAUUACAAG UGUCGGCC | 2264 | CACUUGUAAUC CUA |
| hsa-miR-3160 MIMAT0015034 | 2265 | AGAGCUGAGACUAGAAA GCCCA | 2266 | AGAGCUGAGACU AGAAAGCC | 2267 | CUAGUCUCAGC UCU |
| hsa-miR-3161 MIMAT0015035 | 2268 | CUGAUAAGAACAGAGGC CCAGAU | 2269 | CUGAUAAGAACA GAGGCCCA | 2270 | UCUGUUCUUAU CAG |
| hsa-miR-3162 MIMAT0015036 | 2271 | UUAGGGAGUAGAAGGGU GGGGAG | 2272 | UUAGGGAGUAGA AGGGUGGG | 2273 | CUUCUACUCCC UAA |
| hsa-miR-3163 MIMAT0015037 | 2274 | UAUAAAAUGAGGGCAGU AAGAC | 2275 | UAUAAAAUGAGG GCAGUAAG | 2276 | GCCCUCAUUUU AUA |
| hsa-miR-3164 MIMAT0015038 | 2277 | UGUGACUUUAAGGGAAA UGGCG | 2278 | UGUGACUUUAAG GGAAAUGG | 2279 | CCCUUAAAGUC ACA |
| hsa-miR-3165 MIMAT0015039 | 2280 | AGGUGGAUGCAAUGUGA CCUCA | 2281 | AGGUGGAUGCAA UGUGACCU | 2282 | CAUUGCAUCCA CCU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3166 MIMAT0015040 | 2283 | CGCAGACAAUGCCUACU GGCCUA | 2284 | CGCAGACAAUGC CUACUGGC | 2285 | AGGCAUUGUCU GCG |
| hsa-miR-3167 MIMAT0015042 | 2286 | AGGAUUUCAGAAAUACU GGUGU | 2287 | AGGAUUUCAGAA AUACUGGU | 2288 | AUUUCUGAAAU CCU |
| hsa-miR-3168 MIMAT0015043 | 2289 | GAGUUCUACAGUCAGAC | 2290 | GAGUUCUACAGU CAGAC | 2291 | UGACUGUAGAA CUC |
| hsa-miR-3169 MIMAT0015044 | 2292 | UAGGACUGUGCUUGGCA CAUAG | 2293 | UAGGACUGUGCU UGGCACAU | 2294 | CAAGCACAGUC CUA |
| hsa-miR-3170 MIMAT0015045 | 2295 | CUGGGGUUCUGAGACAG ACAGU | 2296 | CUGGGGUUCUGA GACAGACA | 2297 | UCUCAGAACCC CAG |
| hsa-miR-3171 MIMAT0015046 | 2298 | AGAUGUAUGGAAUCUGU AUAUAUC | 2299 | AGAUGUAUGGAA UCUGUAUA | 2300 | GAUUCCAUACA UCU |
| hsa-miR-3173 MIMAT0015048 | 2301 | AAAGGAGGAAAUAGGCA GGCCA | 2302 | AAAGGAGGAAAU AGGCAGGC | 2303 | CUAUUUCCUCC UUU |
| hsa-miR-3174 MIMAT0015051 | 2304 | UAGUGAGUUAGAGAUGC AGAGCC | 2305 | UAGUGAGUUAGA GAUGCAGA | 2306 | UCUCUAACUCA CUA |
| hsa-miR-3175 MIMAT0015052 | 2307 | CGGGGAGAGAACGCAGU GACGU | 2308 | CGGGGAGAGAAC GCAGUGAC | 2309 | GCGUUCUCUCC CCG |
| hsa-miR-3176 MIMAT0015053 | 2310 | ACUGGCCUGGGACUACC GG | 2311 | ACUGGCCUGGGA CUACCGG | 2312 | AGUCCCAGGCC AGU |
| hsa-miR-3177 MIMAT0015054 | 2313 | UGCACGGCACUGGGGAC ACGU | 2314 | UGCACGGCACUG GGGACACG | 2315 | CCCAGUGCCGU GCA |
| hsa-miR-3178 MIMAT0015055 | 2316 | GGGGCGCGGCCGGAUCG | 2317 | GGGGCGCGGCCG GAUCG | 2318 | UCCGGCCGCGC CCC |
| hsa-miR-3179 MIMAT0015056 | 2319 | AGAAGGGGUGAAAUUUA AACGU | 2320 | AGAAGGGGUGAA AUUUAAAC | 2321 | AUUUCACCCCU UCU |
| hsa-miR-3180 MIMAT0018178 | 2322 | UGGGGCGGAGCUUCCGG AG | 2323 | UGGGGCGGAGCU UCCGGAG | 2324 | GAAGCUCCGCC CCA |
| hsa-miR-3180-3p MIMAT0015058 | 2325 | UGGGGCGGAGCUUCCGG AGGCC | 2326 | UGGGGCGGAGCU UCCGGAGG | 2327 | GAAGCUCCGCC CCA |
| hsa-miR-3180-5p MIMAT0015057 | 2328 | CUUCCAGACGCUCCGCC CCACGUCG | 2329 | CUUCCAGACGCU CCGCCCCA | 2330 | GGAGCGUCUGG AAG |
| hsa-miR-3181 MIMAT0015061 | 2331 | AUCGGGCCCUCGGCGCC GG | 2332 | AUCGGGCCCUCG GCGCCGG | 2333 | GCCGAGGGCCC GAU |
| hsa-miR-3182 MIMAT0015062 | 2334 | GCUUCUGUAGUGUAGUC | 2335 | GCUUCUGUAGUG UAGUC | 2336 | UACACUACAGA AGC |
| hsa-miR-3183 MIMAT0015063 | 2337 | GCCUCUCUCGGAGUCGC UCGGA | 2338 | GCCUCUCUCGGA GUCGCUCG | 2339 | ACUCCGAGAGA GGC |
| hsa-miR-3184 MIMAT0015064 | 2340 | UGAGGGGCCUCAGACCG AGCUUUU | 2341 | UGAGGGGCCUCA GACCGAGC | 2342 | UCUGAGGCCCC UCA |
| hsa-miR-3185 MIMAT0015065 | 2343 | AGAAGAAGGCGGUCGGU CUGCGG | 2344 | AGAAGAAGGCGG UCGGUCUG | 2345 | GACCGCCUUCU UCU |
| hsa-miR-3186-3p MIMAT0015068 | 2346 | UCACGCGGAGAGAUGGC UUUG | 2347 | UCACGCGGAGAG AUGGCUUU | 2348 | AUCUCUCCGCG UGA |
| hsa-miR-3186-5p MIMAT0015067 | 2349 | CAGGCGCUCUGUCUACGU GGCUU | 2350 | CAGGCGCUCUGUC UACGUGGC | 2351 | UAGACAGACGC CUG |
| hsa-miR-3187 MIMAT0015069 | 2352 | UUGGCCAUGGGGCUGCGC CGG | 2353 | UUGGCCAUGGGG CUGCGCGG | 2354 | AGCCCCAUGGC CAA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3188 MIMAT0015070 | 2355 | AGAGGCUUUGUGCGGAU ACGGGG | 2356 | AGAGGCUUUGUG CGGAUACG | 2357 | CGCACAAAGCC UCU |
| hsa-miR-3189 MIMAT0015071 | 2358 | CCCUUGGGUCUGAUGGG GUAG | 2359 | CCCUUGGGUCUG AUGGGGUA | 2360 | AUCAGACCCAA GGG |
| hsa-miR-3190 MIMAT0015073 | 2361 | UGUGGAAGGUAGACGGC CAGAGA | 2362 | UGUGGAAGGUAG ACGGCCAG | 2363 | GUCUACCUUCC ACA |
| hsa-miR-3191 MIMAT0015075 | 2364 | UGGGGACGUAGCUGGCC AGACAG | 2365 | UGGGGACGUAGC UGGCCAGA | 2366 | CAGCUACGUCC CCA |
| hsa-miR-3192 MIMAT0015076 | 2367 | UCUGGGAGGUUGUAGCA GUGGAA | 2368 | UCUGGGAGGUUG UAGCAGUG | 2369 | UACAACCUCCC AGA |
| hsa-miR-3193 MIMAT0015077 | 2370 | UCCUGCGUAGGAUCUGA GGAGU | 2371 | UCCUGCGUAGGA UCUGAGGA | 2372 | GAUCCUACGCA GGA |
| hsa-miR-3194 MIMAT0015078 | 2373 | GGCCAGCCACCAGGAGG GCUG | 2374 | GGCCAGCCACCA GGAGGGCU | 2375 | CCUGGUGGCUG GCC |
| hsa-miR-3195 MIMAT0015079 | 2376 | CGCGCCGGGCCCGGGUU | 2377 | CGCGCCGGGCCC GGGUU | 2378 | CCGGGCCCGGC GCG |
| hsa-miR-3196 MIMAT0015080 | 2379 | CGGGGCGGCAGGGGCCUC | 2380 | CGGGGCGGCAGG GGCCUC | 2381 | CCCCUGCCGCC CCG |
| hsa-miR-3197 MIMAT0015082 | 2382 | GGAGGCGCAGGCUCGGA AAGGCG | 2383 | GGAGGCGCAGGC UCGGAAAG | 2384 | GAGCCUGCGCC UCC |
| hsa-miR-3198 MIMAT0015083 | 2385 | GUGGAGUCCUGGGGAAU GGAGA | 2386 | GUGGAGUCCUGG GGAAUGGA | 2387 | CCCCAGGACUC CAC |
| hsa-miR-3199 MIMAT0015084 | 2388 | AGGGACUGCCUUAGGAG AAAGUU | 2389 | AGGGACUGCCUU AGGAGAAA | 2390 | CUAAGGCAGUC CCU |
| hsa-miR-32 MIMAT0000090 | 2391 | UAUUGCACAUUACUAAG UUGCA | 2392 | UAUUGCACAUUA CUAAGUUG | 2393 | AGUAAUGUGCA AUA |
| hsa-miR-32* MIMAT0004505 | 2394 | CAAUUUAGUGUGUGUGA UAUUU | 2395 | CAAUUUAGUGUG UGUGAUAU | 2396 | CACACACUAAA UUG |
| hsa-miR-3200-3p MIMAT0015085 | 2397 | CACCUUGCGCUACUCAG GUCUG | 2398 | CACCUUGCGCUA CUCAGGUC | 2399 | AGUAGCGCAAG GUG |
| hsa-miR-3200-5p MIMAT0017392 | 2400 | AAUCUGAGAAGGCGCAC AAGGU | 2401 | AAUCUGAGAAGG CGCACAAG | 2402 | CGCCUUCUCAG AUU |
| hsa-miR-3201 MIMAT0015086 | 2403 | GGGAUAUGAAGAAAAAU | 2404 | GGGAUAUGAAGA AAAAU | 2405 | UUUCUUCAUAU CCC |
| hsa-miR-3202 MIMAT0015089 | 2406 | UGGAAGGGAGAAGAGCU UUAAU | 2407 | UGGAAGGGAGAA GAGCUUUA | 2408 | UCUUCUCCCUU CCA |
| hsa-miR-320a MIMAT0000510 | 2409 | AAAAGCUGGGUUGAGAG GGCGA | 2410 | AAAAGCUGGGUU GAGAGGGC | 2411 | UCAACCCAGCU UUU |
| hsa-miR-320b MIMAT0005792 | 2412 | AAAAGCUGGGUUGAGAG GGCAA | 2413 | AAAAGCUGGGUU GAGAGGGC | 2414 | UCAACCCAGCU UUU |
| hsa-miR-320c MIMAT0005793 | 2415 | AAAAGCUGGGUUGAGAG GGU | 2416 | AAAAGCUGGGUU GAGAGGGU | 2417 | UCAACCCAGCU UUU |
| hsa-miR-320d MIMAT0006764 | 2418 | AAAAGCUGGGUUGAGAG GA | 2419 | AAAAGCUGGGUU GAGAGGA | 2420 | UCAACCCAGCU UUU |
| hsa-miR-320e MIMAT0015072 | 2421 | AAAGCUGGGUUGAGAAGG | 2422 | AAAGCUGGGUUG AGAAGG | 2423 | CUCAACCCAGC UUU |
| hsa-miR-323-3p MIMAT0000755 | 2424 | CACAUUACACGGUCGAC CUCU | 2425 | CACAUUACACGG UCGACCUC | 2426 | GACCGUGUAAU GUG |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-323-5p MIMAT0004696 | 2427 | AGGUGGUCCGUGGCGCGUUCGC | 2428 | AGGUGGUCCGUGGCGCGUUC | 2429 | GCCACGGACCACCU |
| hsa-miR-323b-3p MIMAT0015050 | 2430 | CCCAAUACACGGUCGACCUCUU | 2431 | CCCAAUACACGGUCGACCUC | 2432 | GACCGUGUAUUGGG |
| hsa-miR-323b-5p MIMAT0001630 | 2433 | AGGUUGUCCGUGGUGAGUUCGCA | 2434 | AGGUUGUCCGUGGUGAGUUC | 2435 | ACCACGGACAACCU |
| hsa-miR-324-3p MIMAT0000762 | 2436 | ACUGCCCCAGGUGCUGCUGG | 2437 | ACUGCCCCAGGUGCUGCUGG | 2438 | GCACCUGGGGCAGU |
| hsa-miR-324-5p MIMAT0000761 | 2439 | CGCAUCCCCUAGGGCAUUGGUGU | 2440 | CGCAUCCCCUAGGGCAUUGG | 2441 | CCCUAGGGGAUGCG |
| hsa-miR-325 MIMAT0000771 | 2442 | CCUAGUAGGUGUCCAGUAAGUGU | 2443 | CCUAGUAGGUGUCCAGUAAG | 2444 | GGACACCUACUAGG |
| hsa-miR-326 MIMAT0000756 | 2445 | CCUCUGGGCCCUUCCUCCAG | 2446 | CCUCUGGGCCCUUCCUCCAG | 2447 | GAAGGGCCCAGAGG |
| hsa-miR-328 MIMAT0000752 | 2448 | CUGGCCCUCUCUGCCCUUCCGU | 2449 | CUGGCCCUCUCUGCCCUUCC | 2450 | GCAGAGAGGGCCAG |
| hsa-miR-329 MIMAT0001629 | 2451 | AACACACCUGGUUAACCUCUUU | 2452 | AACACACCUGGUUAACCUCU | 2453 | UAACCAGGUGUGUU |
| hsa-miR-330-3p MIMAT0000751 | 2454 | GCAAAGCACACGGCCUGCAGAGA | 2455 | GCAAAGCACACGGCCUGCAG | 2456 | GCCGUGUGCUUUGC |
| hsa-miR-330-5p MIMAT0004693 | 2457 | UCUCUGGGCCUGUGUCUUAGGC | 2458 | UCUCUGGGCCUGUGUCUUAG | 2459 | CACAGGCCCAGAGA |
| hsa-miR-331-3p MIMAT0000760 | 2460 | GCCCCUGGGCCUAUCCUAGAA | 2461 | GCCCCUGGGCCUAUCCUAGA | 2462 | AUAGGCCCAGGGGC |
| hsa-miR-331-5p MIMAT0004700 | 2463 | CUAGGUAUGGUCCCAGGGAUCC | 2464 | CUAGGUAUGGUCCCAGGGAU | 2465 | GGGACCAUACCUAG |
| hsa-miR-335 MIMAT0000765 | 2466 | UCAAGAGCAAUAACGAAAAAUGU | 2467 | UCAAGAGCAAUAACGAAAAA | 2468 | GUUAUUGCUCUUGA |
| hsa-miR-335* MIMAT0004703 | 2469 | UUUUUCAUUAUUGCUCCUGACC | 2470 | UUUUUCAUUAUUGCUCCUGA | 2471 | GCAAUAAUGAAAAA |
| hsa-miR-337-3p MIMAT0000754 | 2472 | CUCCUAUAUGAUGCCUUUCUUC | 2473 | CUCCUAUAUGAUGCCUUUCU | 2474 | GCAUCAUAUAGGAG |
| hsa-miR-337-5p MIMAT0004695 | 2475 | GAACGGCUUCAUACAGGAGUU | 2476 | GAACGGCUUCAUACAGGAGU | 2477 | GUAUGAAGCCGUUC |
| hsa-miR-338-3p MIMAT0000763 | 2478 | UCCAGCAUCAGUGAUUUUGUUG | 2479 | UCCAGCAUCAGUGAUUUUGU | 2480 | UCACUGAUGCUGGA |
| hsa-miR-338-5p MIMAT0004701 | 2481 | AACAAUAUCCUGGUGCUGAGUG | 2482 | AACAAUAUCCUGGUGCUGAG | 2483 | ACCAGGAUAUUGUU |
| hsa-miR-339-3p MIMAT0004702 | 2484 | UGAGCGCCUCGACGACAGAGCCG | 2485 | UGAGCGCCUCGACGACAGAG | 2486 | CGUCGAGGCGCUCA |
| hsa-miR-339-5p MIMAT0000764 | 2487 | UCCCUGUCCUCCAGGAGCUCACG | 2488 | UCCCUGUCCUCCAGGAGCUC | 2489 | CUGGAGGACAGGGA |
| hsa-miR-33a MIMAT0000091 | 2490 | GUGCAUUGUAGUUGCAUUGCA | 2491 | GUGCAUUGUAGUUGCAUUGC | 2492 | CAACUACAAUGCAC |
| hsa-miR-33a* MIMAT0004506 | 2493 | CAAUGUUUCCACAGUGCAUCAC | 2494 | CAAUGUUUCCACAGUGCAUC | 2495 | CUGUGGAAACAUUG |
| hsa-miR-33b MIMAT0003301 | 2496 | GUGCAUUGCUGUUGCAUUGC | 2497 | GUGCAUUGCUGUUGCAUUGC | 2498 | CAACAGCAAUGCAC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-33b* MIMAT0004811 | 2499 | CAGUGCCUCGGCAGUGC AGCCC | 2500 | CAGUGCCUCGGC AGUGCAGC | 2501 | CUGCCGAGGCA CUG |
| hsa-miR-340 MIMAT0004692 | 2502 | UUAUAAAGCAAUGAGAC UGAUU | 2503 | UUAUAAAGCAAU GAGACUGA | 2504 | UCAUUGCUUUA UAA |
| hsa-miR-340* MIMAT0000750 | 2505 | UCCGUCUCAGUUACUUU AUAGC | 2506 | UCCGUCUCAGUU ACUUUAUA | 2507 | GUAACUGAGAC GGA |
| hsa-miR-342-3p MIMAT0000753 | 2508 | UCUCACACAGAAAUCGC ACCCGU | 2509 | UCUCACACAGAA AUCGCACC | 2510 | AUUUCUGUGUG AGA |
| hsa-miR-342-5p MIMAT0004694 | 2511 | AGGGGUGCUAUCUGUGA UUGA | 2512 | AGGGGUGCUAUC UGUGAUUG | 2513 | CAGAUAGCACC CCU |
| hsa-miR-345 MIMAT0000772 | 2514 | GCUGACUCCUAGUCCAG GGCUC | 2515 | GCUGACUCCUAG UCCAGGGC | 2516 | GACUAGGAGUC AGC |
| hsa-miR-346 MIMAT0000773 | 2517 | UGUCUGCCCGCAUGCCU GCCUCU | 2518 | UGUCUGCCCGCA UGCCUGCC | 2519 | CAUGCGGGCAG ACA |
| hsa-miR-34a MIMAT0000255 | 2520 | UGGCAGUGUCUUAGCUG GUUGU | 2521 | UGGCAGUGUCUU AGCUGGUU | 2522 | CUAAGACACUG CCA |
| hsa-miR-34a* MIMAT0004557 | 2523 | CAAUCAGCAAGUAUACU GCCCU | 2524 | CAAUCAGCAAGU AUACUGCC | 2525 | AUACUUGCUGA UUG |
| hsa-miR-34b MIMAT0004676 | 2526 | CAAUCACUAACUCCACU GCCAU | 2527 | CAAUCACUAACU CCACUGCC | 2528 | GGAGUUAGUGA UUG |
| hsa-miR-34b* MIMAT0000685 | 2529 | UAGGCAGUGUCAUUAGC UGAUUG | 2530 | UAGGCAGUGUCA UUAGCUGA | 2531 | AAUGACACUGC CUA |
| hsa-miR-34c-3p MIMAT0004677 | 2532 | AAUCACUAACCACACGG CCAGG | 2533 | AAUCACUAACCA CACGGCCA | 2534 | UGGGUUAGUG AUU |
| hsa-miR-34c-5p MIMAT0000686 | 2535 | AGGCAGUGUAGUUAGCU GAUUGC | 2536 | AGGCAGUGUAGU UAGCUGAU | 2537 | UAACUACACUG CCU |
| hsa-miR-3605-3p MIMAT0017982 | 2538 | CCUCCGUGUUACCUGUC CUCUAG | 2539 | CCUCCGUGUUAC CUGUCCUC | 2540 | AGGUAACACGG AGG |
| hsa-miR-3605-5p MIMAT0017981 | 2541 | UGAGGAUGGAUAGCAAG GAAGCC | 2542 | UGAGGAUGGAUA GCAAGGAA | 2543 | GCUAUCCAUCC UCA |
| hsa-miR-3606 MIMAT0017983 | 2544 | UUAGUGAAGGCUAUUUU AAUU | 2545 | UUAGUGAAGGCU AUUUUAAU | 2546 | AUAGCCUUCAC UAA |
| hsa-miR-3607-3p MIMAT0017985 | 2547 | ACUGUAAACGCUUUCUG AUG | 2548 | ACUGUAAACGCU UUCUGAUG | 2549 | AAAGCGUUUAC AGU |
| hsa-miR-3607-5p MIMAT0017984 | 2550 | GCAUGUGAUGAAGCAAA UCAGU | 2551 | GCAUGUGAUGAA GCAAAUCA | 2552 | GCUUCAUCACA UGC |
| hsa-miR-3609 MIMAT0017986 | 2553 | CAAAGUGAUGAGUAAUA CUGGCUG | 2554 | CAAAGUGAUGAG UAAUACUG | 2555 | UACUCAUCACU UUG |
| hsa-miR-3610 MIMAT0017987 | 2556 | GAAUCGGAAAGGAGGCG CCG | 2557 | GAAUCGGAAAGG AGGCGCCG | 2558 | CUCCUUUCCGA UUC |
| hsa-miR-3611 MIMAT0017988 | 2559 | UUGUGAAGAAAGAAAUU CUUA | 2560 | UUGUGAAGAAAG AAAUUCUU | 2561 | UUCUUUCUUCA CAA |
| hsa-miR-3612 MIMAT0017989 | 2562 | AGGAGGCAUCUUGAGAA AUGGA | 2563 | AGGAGGCAUCUU GAGAAAUG | 2564 | UCAAGAUGCCU CCU |
| hsa-miR-3613-3p MIMAT0017991 | 2565 | ACAAAAAAAAAAGCCCA ACCCUUC | 2566 | ACAAAAAAAAAA GCCCAACC | 2567 | GCUUUUUUUU UGU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3613-5p MIMAT0017990 | 2568 | UGUUGUACUUUUUUUUUGUUC | 2569 | UGUUGUACUUUUUUUUUGU | 2570 | AAAAAGUACAACA |
| hsa-miR-361-3p MIMAT0004682 | 2571 | UCCCCCAGGUGUGAUUCUGAUUU | 2572 | UCCCCCAGGUGUGAUUCUGA | 2573 | UCACACCUGGGGGA |
| hsa-miR-3614-3p MIMAT0017993 | 2574 | UAGCCUUCAGAUCUUGGUGUUUU | 2575 | UAGCCUUCAGAUCUUGGUGU | 2576 | AGAUCUGAAGGCUA |
| hsa-miR-3614-5p MIMAT0017992 | 2577 | CCACUUGGAUCUGAAGGCUGCCC | 2578 | CCACUUGGAUCUGAAGGCUG | 2579 | UCAGAUCCAAGUGG |
| hsa-miR-3615 MIMAT0017994 | 2580 | UCUCUCGGCUCCUCGCGGCUC | 2581 | UCUCUCGGCUCCUCGCGGCU | 2582 | GAGGAGCCGAGAGA |
| hsa-miR-361-5p MIMAT0000703 | 2583 | UUAUCAGAAUCUCCAGGGUAC | 2584 | UUAUCAGAAUCUCCAGGGGU | 2585 | GGAGAUUCUGAUAA |
| hsa-miR-3616-3p MIMAT0017996 | 2586 | CGAGGGCAUUUCAUGAUGCAGGC | 2587 | CGAGGGCAUUUCAUGAUGCA | 2588 | AUGAAAUGCCCUCG |
| hsa-miR-3616-5p MIMAT0017995 | 2589 | AUGAAGUGCACUCAUGAUAUGU | 2590 | AUGAAGUGCACUCAUGAUAU | 2591 | UGAGUGCACUUCAU |
| hsa-miR-3617 MIMAT0017997 | 2592 | AAAGACAUAGUUGCAAGAUGGG | 2593 | AAAGACAUAGUUGCAAGAUG | 2594 | GCAACUAUGUCUUU |
| hsa-miR-3618 MIMAT0017998 | 2595 | UGUCUACAUUAAUGAAAAGAGC | 2596 | UGUCUACAUUAAUGAAAAGA | 2597 | CAUUAAUGUAGACA |
| hsa-miR-3619 MIMAT0017999 | 2598 | UCAGCAGGCAGGCUGGUGCAGC | 2599 | UCAGCAGGCAGGCUGGUGCA | 2600 | AGCCUGCCUGCUGA |
| hsa-miR-3620 MIMAT0018001 | 2601 | UCACCCUGCAUCCCGCACCCAG | 2602 | UCACCCUGCAUCCCGCACCC | 2603 | GGGAUGCAGGGUGA |
| hsa-miR-3621 MIMAT0018002 | 2604 | CGCGGGUCGGGGUCUGCAGG | 2605 | CGCGGGUCGGGGUCUGCAGG | 2606 | GACCCCGACCCGCG |
| hsa-miR-3622a-3p MIMAT0018004 | 2607 | UCACCUGACCUCCCAUGCCUGU | 2608 | UCACCUGACCUCCCAUGCCU | 2609 | GGGAGGUCAGGUGA |
| hsa-miR-3622a-5p MIMAT0018003 | 2610 | CAGGCACGGGAGCUCAGGUGAG | 2611 | CAGGCACGGGAGCUCAGGUG | 2612 | AGCUCCCGUGCCUG |
| hsa-miR-3622b-3p MIMAT0018006 | 2613 | UCACCUGAGCUCCCGUGCCUG | 2614 | UCACCUGAGCUCCCGUGCCU | 2615 | GGGAGCUCAGGUGA |
| hsa-miR-3622b-5p MIMAT0018005 | 2616 | AGGCAUGGGAGGUCAGGUGA | 2617 | AGGCAUGGGAGGUCAGGUGA | 2618 | GACCUCCCAUGCCU |
| hsa-miR-362-3p MIMAT0004683 | 2619 | AACACACCUAUUCAAGGAUUCA | 2620 | AACACACCUAUUCAAGGAUU | 2621 | UGAAUAGGUGUGUU |
| hsa-miR-362-5p MIMAT0000705 | 2622 | AAUCCUUGGAACCUAGGUGUGAGU | 2623 | AAUCCUUGGAACCUAGGUGU | 2624 | AGGUUCCAAGGAUU |
| hsa-miR-363 MIMAT0000707 | 2625 | AAUUGCACGGUAUCCAUCUGUA | 2626 | AAUUGCACGGUAUCCAUCUG | 2627 | GAUACCGUGCAAUU |
| hsa-miR-363* MIMAT0003385 | 2628 | CGGGUGGAUCACGAUGCAAUUU | 2629 | CGGGUGGAUCACGAUGCAAU | 2630 | UCGUGAUCCACCCG |
| hsa-miR-3646 MIMAT0018065 | 2631 | AAAAUGAAAUGAGCCCAGCCCA | 2632 | AAAAUGAAAUGAGCCCAGCC | 2633 | GCUCAUUUCAUUUU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3647-3p MIMAT0018067 | 2634 | AGAAAAUUUUGUGUGU CUGAUC | 2635 | AGAAAAUUUUG UGUGUCUG | 2636 | CACAAAAAUUU UCU |
| hsa-miR-3647-5p MIMAT0018066 | 2637 | CUGAAGUGAUGAUUCAC AUUCAU | 2638 | CUGAAGUGAUGA UUCACAUU | 2639 | AAUCAUCACUU CAG |
| hsa-miR-3648 MIMAT0018068 | 2640 | AGCCGCGGGGAUCGCCG AGGG | 2641 | AGCCGCGGGGAU CGCCGAGG | 2642 | CGAUCCCCGCG GCU |
| hsa-miR-3649 MIMAT0018069 | 2643 | AGGGACCUGAGUGUCUA AG | 2644 | AGGGACCUGAGU GUCUAAG | 2645 | ACACUCAGGUC CCU |
| hsa-miR-365 MIMAT0000710 | 2646 | UAAUGCCCCUAAAAAUC CUUAU | 2647 | UAAUGCCCCUAA AAAUCCUU | 2648 | UUUUAGGGGCA UUA |
| hsa-miR-365* MIMAT0009199 | 2649 | AGGGACUUUCAGGGGCA GCUGU | 2650 | AGGGACUUUCAG GGGCAGCU | 2651 | CCCUGAAAGUC CCU |
| hsa-miR-3650 MIMAT0018070 | 2652 | AGGUGUGUCUGUAGAGU CC | 2653 | AGGUGUGUCUGU AGAGUCC | 2654 | CUACAGACACA CCU |
| hsa-miR-3651 MIMAT0018071 | 2655 | CAUAGCCCGGUCGCUGG UACAUGA | 2656 | CAUAGCCCGGUC GCUGGUAC | 2657 | GCGACCGGGCU AUG |
| hsa-miR-3652 MIMAT0018072 | 2658 | CGGCUGGAGGUGUGAGGA | 2659 | CGGCUGGAGGUG UGAGGA | 2660 | CACACCUCCAG CCG |
| hsa-miR-3653 MIMAT0018073 | 2661 | CUAAGAAGUUGACUGAAG | 2662 | CUAAGAAGUUGA CUGAAG | 2663 | AGUCAACUUCU UAG |
| hsa-miR-3654 MIMAT0018074 | 2664 | GACUGGACAAGCUGAGG AA | 2665 | GACUGGACAAGC UGAGGAA | 2666 | CAGCUUGUCCA GUC |
| hsa-miR-3655 MIMAT0018075 | 2667 | GCUUGUCGCUGCGGUGU UGCU | 2668 | GCUUGUCGCUGC GGUGUUGC | 2669 | CCGCAGCGACA AGC |
| hsa-miR-3656 MIMAT0018076 | 2670 | GGCGGGUGCGGGGUGG | 2671 | GGCGGGUGCGGG GGUGG | 2672 | CCCCCGCACCC GCC |
| hsa-miR-3657 MIMAT0018077 | 2673 | UGUGUCCCAUUAUUGGU GAUU | 2674 | UGUGUCCCAUUA UUGGUGAU | 2675 | AAUAAUGGGAC ACA |
| hsa-miR-3658 MIMAT0018078 | 2676 | UUUAAGAAAACACCAUG GAGAU | 2677 | UUUAAGAAAACA CCAUGGAG | 2678 | GGUGUUUUCUU AAA |
| hsa-miR-3659 MIMAT0018080 | 2679 | UGAGUGUUGUCUACGAG GGCA | 2680 | UGAGUGUUGUCU ACGAGGGC | 2681 | GUAGACAACAC UCA |
| hsa-miR-3660 MIMAT0018081 | 2682 | ACUGACAGGAGAGCAUU UUGA | 2683 | ACUGACAGGAGA GCAUUUUG | 2684 | GCUCUCCUGUC AGU |
| hsa-miR-3661 MIMAT0018082 | 2685 | UGACCUGGGACUCGGAC AGCUG | 2686 | UGACCUGGGACU CGGACAGC | 2687 | CGAGUCCCAGG UCA |
| hsa-miR-3662 MIMAT0018083 | 2688 | GAAAAUGAUGAGUAGUG ACUGAUG | 2689 | GAAAAUGAUGAG UAGUGACU | 2690 | UACUCAUCAUU UUC |
| hsa-miR-3663-3p MIMAT0018085 | 2691 | UGAGCACCACACAGGCC GGGCGC | 2692 | UGAGCACCACAC AGGCCGGG | 2693 | CUGUGUGGUGC UCA |
| hsa-miR-3663-5p MIMAT0018084 | 2694 | GCUGGUCUGCGUGGUGC UCGG | 2695 | GCUGGUCUGCGU GGUGCUCG | 2696 | CCACGCAGACC AGC |
| hsa-miR-3664 MIMAT0018086 | 2697 | AACUCUGUCUUCACUCA UGAGU | 2698 | AACUCUGUCUUC ACUCAUGA | 2699 | GUGAAGACAGA GUU |
| hsa-miR-3665 MIMAT0018087 | 2700 | AGCAGGUGCGGGCGGCG | 2701 | AGCAGGUGCGGG GCGGCG | 2702 | GCCCCGCACCU GCU |
| hsa-miR-3666 MIMAT0018088 | 2703 | CAGUGCAAGUGUAGAUG CCGA | 2704 | CAGUGCAAGUGU AGAUGCCG | 2705 | CUACACUUGCA CUG |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3667-3p MIMAT0018090 | 2706 | ACCUUCCUCUCCAUGGG UCUUU | 2707 | ACCUUCCUCUCC AUGGGUCU | 2708 | AUGGAGAGGAA GGU |
| hsa-miR-3667-5p MIMAT0018089 | 2709 | AAAGACCCAUUGAGGAG AAGGU | 2710 | AAAGACCCAUUG AGGAGAAG | 2711 | CUCAAUGGGUC UUU |
| hsa-miR-3668 MIMAT0018091 | 2712 | AAUGUAGAGAUUGAUCA AAAU | 2713 | AAUGUAGAGAUU GAUCAAAA | 2714 | UCAAUCUCUAC AUU |
| hsa-miR-3669 MIMAT0018092 | 2715 | ACGGAAUAUGUAUACGG AAUAUA | 2716 | ACGGAAUAUGUA UACGGAAU | 2717 | UAUACAUAUUC CGU |
| hsa-miR-367 MIMAT0000719 | 2718 | AAUUGCACUUUAGCAAU GGUGA | 2719 | AAUUGCACUUUA GCAAUGGU | 2720 | GCUAAAGUGCA AUU |
| hsa-miR-367* MIMAT0004686 | 2721 | ACUGUUGCUAAUAUGCA ACUCU | 2722 | ACUGUUGCUAAU AUGCAACU | 2723 | AUAUUAGCAAC AGU |
| hsa-miR-3670 MIMAT0018093 | 2724 | AGAGCUCACAGCUGUCC UUCUCUA | 2725 | AGAGCUCACAGC UGUCCUUC | 2726 | CAGCUGUGAGC UCU |
| hsa-miR-3671 MIMAT0018094 | 2727 | AUCAAAUAAGGACUAGU CUGCA | 2728 | AUCAAAUAAGGA CUAGUCUG | 2729 | AGUCCUUAUUU GAU |
| hsa-miR-3672 MIMAT0018095 | 2730 | AUGAGACUCAUGUAAAA CAUCUU | 2731 | AUGAGACUCAUG UAAAACAU | 2732 | UACAUGAGUCU CAU |
| hsa-miR-3673 MIMAT0018096 | 2733 | AUGGAAUGUAUAUACGG AAUA | 2734 | AUGGAAUGUAUA UACGGAAU | 2735 | UAUAUACAUUC CAU |
| hsa-miR-3674 MIMAT0018097 | 2736 | AUUGUAGAACCUAAGAU UGGCC | 2737 | AUUGUAGAACCU AAGAUUGG | 2738 | UUAGGUUCUAC AAU |
| hsa-miR-3675-3p MIMAT0018099 | 2739 | CAUCUCUAAGGAACUCC CCCAA | 2740 | CAUCUCUAAGGA ACUCCCCC | 2741 | GUUCCUUAGAG AUG |
| hsa-miR-3675-5p MIMAT0018098 | 2742 | UAUGGGGCUUCUGUAGA GAUUUC | 2743 | UAUGGGGCUUCU GUAGAGAU | 2744 | ACAGAAGCCCC AUA |
| hsa-miR-3676 MIMAT0018100 | 2745 | CCGUGUUUCCCCCACGC UUU | 2746 | CCGUGUUUCCCC CACGCUUU | 2747 | UGGGGGAAACA CGG |
| hsa-miR-3677 MIMAT0018101 | 2748 | CUCGUGGGCUCUGGCCA CGGCC | 2749 | CUCGUGGGCUCU GGCCACGG | 2750 | CCAGAGCCCAC GAG |
| hsa-miR-3678-3p MIMAT0018103 | 2751 | CUGCAGAGUUUGUACGG ACCGG | 2752 | CUGCAGAGUUUG UACGGACC | 2753 | UACAAACUCUG CAG |
| hsa-miR-3678-5p MIMAT0018102 | 2754 | UCCGUACAAACUCUGCU GUG | 2755 | UCCGUACAAACU CUGCUGUG | 2756 | AGAGUUUGUAC GGA |
| hsa-miR-3679-3p MIMAT0018105 | 2757 | CUUCCCCCCAGUAAUCU UCAUC | 2758 | CUUCCCCCCAGU AAUCUUCA | 2759 | UUACUGGGGGG AAG |
| hsa-miR-3679-5p MIMAT0018104 | 2760 | UGAGGAUAUGGCAGGGA AGGGA | 2761 | UGAGGAUAUGGC AGGGAAGG | 2762 | CUGCCAUAUCC UCA |
| hsa-miR-3680 MIMAT0018106 | 2763 | GACUCACUCACAGGAUU GUGCA | 2764 | GACUCACUCACA GGAUUGUG | 2765 | CCUGUGAGUGA GUC |
| hsa-miR-3680* MIMAT0018107 | 2766 | UUUUGCAUGACCCUGGG AGUAGG | 2767 | UUUUGCAUGACC CUGGGAGU | 2768 | AGGGUCAUGCA AAA |
| hsa-miR-3681 MIMAT0018108 | 2769 | UAGUGGAUGAUGCACUC UGUGC | 2770 | UAGUGGAUGAUG CACUCUGU | 2771 | UGCAUCAUCCA CUA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3681* MIMAT0018109 | 2772 | ACACAGUGCUUCAUCCA CUACU | 2773 | ACACAGUGCUUC AUCCACUA | 2774 | AUGAAGCACUG UGU |
| hsa-miR-3682 MIMAT0018110 | 2775 | UGAUGAUACAGGUGGAG GUAG | 2776 | UGAUGAUACAGG UGGAGGUA | 2777 | CACCUGUAUCA UCA |
| hsa-miR-3683 MIMAT0018111 | 2778 | UGCGACAUUGGAAGUAG UAUCA | 2779 | UGCGACAUUGGA AGUAGUAU | 2780 | CUUCCAAUGUC GCA |
| hsa-miR-3684 MIMAT0018112 | 2781 | UUAGACCUAGUACACGU CCUU | 2782 | UUAGACCUAGUA CACGUCCU | 2783 | UGUACUAGGUC UAA |
| hsa-miR-3685 MIMAT0018113 | 2784 | UUUCCUACCCUACCUGA AGACU | 2785 | UUUCCUACCCUA CCUGAAGA | 2786 | GGUAGGGUAGG AAA |
| hsa-miR-3686 MIMAT0018114 | 2787 | AUCUGUAAGAGAAAGUA AAUGA | 2788 | AUCUGUAAGAGA AAGUAAAU | 2789 | UUUCUCUUACA GAU |
| hsa-miR-3687 MIMAT0018115 | 2790 | CCCGGACAGGCGUUCGU GCGACGU | 2791 | CCCGGACAGGCG UUCGUGCG | 2792 | AACGCCUGUCC GGG |
| hsa-miR-3688 MIMAT0018116 | 2793 | UAUGGAAAGACUUUGCC ACUCU | 2794 | UAUGGAAAGACU UUGCCACU | 2795 | AAAGUCUUUCC AUA |
| hsa-miR-3689a-3p MIMAT0018118 | 2796 | CUGGGAGGUGUGAUAUC GUGGU | 2797 | CUGGGAGGUGUG AUAUCGUG | 2798 | AUCACACCUCC CAG |
| hsa-miR-3689a-5p MIMAT0018117 | 2799 | UGUGAUAUCAUGGUUCC UGGGA | 2800 | UGUGAUAUCAUG GUUCCUGG | 2801 | ACCAUGAUAUC ACA |
| hsa-miR-3689b MIMAT0018180 | 2802 | UGUGAUAUCAUGGUUCC UGGGA | 2803 | UGUGAUAUCAUG GUUCCUGG | 2804 | ACCAUGAUAUC ACA |
| hsa-miR-3689b* MIMAT0018181 | 2805 | CUGGGAGGUGUGAUAUU GUGGU | 2806 | CUGGGAGGUGUG AUAUUGUG | 2807 | AUCACACCUCC CAG |
| hsa-miR-3690 MIMAT0018119 | 2808 | ACCUGGACCCAGCGUAG ACAAAG | 2809 | ACCUGGACCCAG CGUAGACA | 2810 | CGCUGGGUCCA GGU |
| hsa-miR-3691 MIMAT0018120 | 2811 | AGUGGAUGAUGGAGACU CGGUAC | 2812 | AGUGGAUGAUGG AGACUCGG | 2813 | CUCCAUCAUCC ACU |
| hsa-miR-3692 MIMAT0018122 | 2814 | GUUCCACACUGACACUG CAGAAGU | 2815 | GUUCCACACUGA CACUGCAG | 2816 | UGUCAGUGUGG AAC |
| hsa-miR-3692* MIMAT0018121 | 2817 | CCUGCUGGUCAGGAGUG GAUACUG | 2818 | CCUGCUGGUCAG GAGUGGAU | 2819 | UCCUGACCAGC AGG |
| hsa-miR-369-3p MIMAT0000721 | 2820 | AAUAAUACAUGGUUGAU CUUU | 2821 | AAUAAUACAUGG UUGAUCUU | 2822 | AACCAUGUAUU AUU |
| hsa-miR-369-5p MIMAT0001621 | 2823 | AGAUCGACCGUGUUAUA UUCGC | 2824 | AGAUCGACCGUG UUAUAUUC | 2825 | AACACGGUCGA UCU |
| hsa-miR-370 MIMAT0000722 | 2826 | GCCUGCUGGGGUGGAAC CUGGU | 2827 | GCCUGCUGGGGU GGAACCUG | 2828 | CCACCCCAGCA GGC |
| hsa-miR-3713 MIMAT0018164 | 2829 | GGUAUCCGUUUGGGAUG GU | 2830 | GGUAUCCGUUUG GGAUGGU | 2831 | CCCAAACGGAU ACC |
| hsa-miR-371-3p MIMAT0000723 | 2832 | AAGUGCCGCCAUCUUUU GAGUGU | 2833 | AAGUGCCGCCAU CUUUUGAG | 2834 | AGAUGGCGGCA CUU |
| hsa-miR-3714 MIMAT0018165 | 2835 | GAAGGCAGCAGUGCUCC CCUGU | 2836 | GAAGGCAGCAGU GCUCCCCU | 2837 | GCACUGCUGCC UUC |
| hsa-miR-371-5p MIMAT0004687 | 2838 | ACUCAAACUGUGGGGGC ACU | 2839 | ACUCAAACUGUG GGGGCACU | 2840 | CCCACAGUUUG AGU |
| hsa-miR-372 MIMAT0000724 | 2841 | AAAGUGCUGCGACAUUU GAGCGU | 2842 | AAAGUGCUGCGA CAUUUGAG | 2843 | UGUCGCAGCAC UUU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-373 MIMAT0000726 | 2844 | GAAGUGCUUCGAUUUUG GGGUGU | 2845 | GAAGUGCUUCGA UUUUGGGG | 2846 | AAUCGAAGCAC UUC |
| hsa-miR-373* MIMAT0000725 | 2847 | ACUCAAAAUGGGGGCGC UUUCC | 2848 | ACUCAAAAUGGG GGCGCUUU | 2849 | CCCCCAUUUUG AGU |
| hsa-miR-374a MIMAT0000727 | 2850 | UUAUAAUACAACCUGAU AAGUG | 2851 | UUAUAAUACAAC CUGAUAAG | 2852 | AGGUUGUAUUA UAA |
| hsa-miR-374a* MIMAT0004688 | 2853 | CUUAUCAGAUUGUAUUG UAAUU | 2854 | CUUAUCAGAUUG UAUUGUAA | 2855 | UACAAUCUGAU AAG |
| hsa-miR-374b MIMAT0004955 | 2856 | AUAUAAUACAACCUGCU AAGUG | 2857 | AUAUAAUACAAC CUGCUAAG | 2858 | AGGUUGUAUUA UAU |
| hsa-miR-374b* MIMAT0004956 | 2859 | CUUAGCAGGUUGUAUUA UCAUU | 2860 | CUUAGCAGGUUG UAUUAUCA | 2861 | UACAACCUGCU AAG |
| hsa-miR-374c MIMAT0018443 | 2862 | AUAAUACAACCUGCUAA GUGCU | 2863 | AUAAUACAACCU GCUAAGUG | 2864 | GCAGGUUGUAU UAU |
| hsa-miR-375 MIMAT0000728 | 2865 | UUUGUUCGUUCGGCUCG CGUGA | 2866 | UUUGUUCGUUCG GCUCGCGU | 2867 | GCCGAACGAAC AAA |
| hsa-miR-376a MIMAT0000729 | 2868 | AUCAUAGAGGAAAAUCC ACGU | 2869 | AUCAUAGAGGAA AAUCCACG | 2870 | UUUUCCUCUAU GAU |
| hsa-miR-376a* MIMAT0003386 | 2871 | GUAGAUUCUCCUUCUAU GAGUA | 2872 | GUAGAUUCUCCU UCUAUGAG | 2873 | GAAGGAGAAUC UAC |
| hsa-miR-376b MIMAT0002172 | 2874 | AUCAUAGAGGAAAAUCC AUGUU | 2875 | AUCAUAGAGGAA AAUCCAUG | 2876 | UUUUCCUCUAU GAU |
| hsa-miR-376c MIMAT0000720 | 2877 | AACAUAGAGGAAAUUCC ACGU | 2878 | AACAUAGAGGAA AUUCCACG | 2879 | AUUUCCUCUAU GUU |
| hsa-miR-377 MIMAT0000730 | 2880 | AUCACACAAAGGCAACU UUUGU | 2881 | AUCACACAAAGG CAACUUUU | 2882 | UGCCUUUGUGU GAU |
| hsa-miR-377* MIMAT0004689 | 2883 | AGAGGUUGCCCUUGGUG AAUUC | 2884 | AGAGGUUGCCCU UGGUGAAU | 2885 | CAAGGGCAACC UCU |
| hsa-miR-378 MIMAT0000732 | 2886 | ACUGGACUUGGAGUCAG AAGG | 2887 | ACUGGACUUGGA GUCAGAAG | 2888 | ACUCCAAGUCC AGU |
| hsa-miR-378* MIMAT0000731 | 2889 | CUCCUGACUCCAGGUCC UGUGU | 2890 | CUCCUGACUCCA GGUCCUGU | 2891 | CCUGGAGUCAG GAG |
| hsa-miR-378b MIMAT0014999 | 2892 | ACUGGACUUGGAGGCAG AA | 2893 | ACUGGACUUGGA GGCAGAA | 2894 | CCUCCAAGUCC AGU |
| hsa-miR-378c MIMAT0016847 | 2895 | ACUGGACUUGGAGUCAG AAGAGUGG | 2896 | ACUGGACUUGGA GUCAGAAG | 2897 | ACUCCAAGUCC AGU |
| hsa-miR-379 MIMAT0000733 | 2898 | UGGUAGACUAUGGAACG UAGG | 2899 | UGGUAGACUAUG GAACGUAG | 2900 | UCCAUAGUCUA CCA |
| hsa-miR-379* MIMAT0004690 | 2901 | UAUGUAACAUGGUCCAC UAACU | 2902 | UAUGUAACAUGG UCCACUAA | 2903 | GACCAUGUUAC AUA |
| hsa-miR-380 MIMAT0000735 | 2904 | UAUGUAAUAUGGUCCAC AUCUU | 2905 | UAUGUAAUAUGG UCCACAUC | 2906 | GACCAUAUUAC AUA |
| hsa-miR-380* MIMAT0000734 | 2907 | UGGUUGACCAUAGAACA UGCGC | 2908 | UGGUUGACCAUA GAACAUGC | 2909 | UCUAUGGUCAA CCA |
| hsa-miR-381 MIMAT0000736 | 2910 | UAUACAAGGGCAAGCUC UCUGU | 2911 | UAUACAAGGGCA AGCUCUCU | 2912 | CUUGCCCUUGU AUA |
| hsa-miR-382 MIMAT0000737 | 2913 | GAAGUUGUUCGUGGUGG AUUCG | 2914 | GAAGUUGUUCGU GGUGGAUU | 2915 | CCACGAACAAC UUC |
| hsa-miR-383 MIMAT0000738 | 2916 | AGAUCAGAAGGUGAUUG UGGCU | 2917 | AGAUCAGAAGGU GAUUGUGG | 2918 | UCACCUUCUGA UCU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-384 MIMAT0001075 | 2919 | AUUCCUAGAAAUUGUUC AUA | 2920 | AUUCCUAGAAAU UGUUCAUA | 2921 | CAAUUUCUAGG AAU |
| hsa-miR-3907 MIMAT0018179 | 2922 | AGGUGCUCCAGGCUGGC UCACA | 2923 | AGGUGCUCCAGG CUGGCUCA | 2924 | AGCCUGGAGCA CCU |
| hsa-miR-3908 MIMAT0018182 | 2925 | GAGCAAUGUAGGUAGAC UGUUU | 2926 | GAGCAAUGUAGG UAGACUGU | 2927 | UACCUACAUUG CUC |
| hsa-miR-3909 MIMAT0018183 | 2928 | UGUCCUCUAGGGCCUGC AGUCU | 2929 | UGUCCUCUAGGG CCUGCAGU | 2930 | GGCCCUAGAGG ACA |
| hsa-miR-3910 MIMAT0018184 | 2931 | AAAGGCAUAAAACCAAG ACA | 2932 | AAAGGCAUAAAA CCAAGACA | 2933 | GGUUUUAUGCC UUU |
| hsa-miR-3911 MIMAT0018185 | 2934 | UGUGUGGAUCCUGGAGG AGGCA | 2935 | UGUGUGGAUCCU GGAGGAGG | 2936 | CCAGGAUCCAC ACA |
| hsa-miR-3912 MIMAT0018186 | 2937 | UAACGCAUAAUAUGGAC AUGU | 2938 | UAACGCAUAAUA UGGACAUG | 2939 | CAUAUUAUGCG UUA |
| hsa-miR-3913 MIMAT0018187 | 2940 | UUUGGGACUGAUCUUGA UGUCU | 2941 | UUUGGGACUGAU CUUGAUGU | 2942 | AGAUCAGUCCC AAA |
| hsa-miR-3914 MIMAT0018188 | 2943 | AAGGAACCAGAAAAUGA GAAGU | 2944 | AAGGAACCAGAA AAUGAGAA | 2945 | UUUUCUGGUUC CUU |
| hsa-miR-3915 MIMAT0018189 | 2946 | UUGAGGAAAAGAUGGUC UUAUU | 2947 | UUGAGGAAAAGA UGGUCUUA | 2948 | CAUCUUUUCCU CAA |
| hsa-miR-3916 MIMAT0018190 | 2949 | AAGAGGAAGAAAUGGCU GGUUCUCAG | 2950 | AAGAGGAAGAAA UGGCUGGU | 2951 | CAUUUCUUCCU CUU |
| hsa-miR-3917 MIMAT0018191 | 2952 | GCUCGGACUGAGCAGGU GGG | 2953 | GCUCGGACUGAG CAGGUGGG | 2954 | UGCUCAGUCCG AGC |
| hsa-miR-3918 MIMAT0018192 | 2955 | ACAGGGCCGCAGAUGGA GACU | 2956 | ACAGGGCCGCAG AUGGAGAC | 2957 | AUCUGCGGCCC UGU |
| hsa-miR-3919 MIMAT0018193 | 2958 | GCAGAGAACAAAGGACU CAGU | 2959 | GCAGAGAACAAA GGACUCAG | 2960 | CCUUUGUUCUC UGC |
| hsa-miR-3920 MIMAT0018195 | 2961 | ACUGAUUAUCUUAACUC UCUGA | 2962 | ACUGAUUAUCUU AACUCUCU | 2963 | UUAAGAUAAUC AGU |
| hsa-miR-3921 MIMAT0018196 | 2964 | UCUCUGAGUACCAUAUG CCUUGU | 2965 | UCUCUGAGUACC AUAUGCCU | 2966 | AUGGUACUCAG AGA |
| hsa-miR-3922 MIMAT0018197 | 2967 | UCUGGCCUUGACUUGAC UCUUU | 2968 | UCUGGCCUUGAC UUGACUCU | 2969 | AAGUCAAGGCC AGA |
| hsa-miR-3923 MIMAT0018198 | 2970 | AACUAGUAAUGUUGGAU UAGGG | 2971 | AACUAGUAAUGU UGGAUUAG | 2972 | CAACAUUACUA GUU |
| hsa-miR-3924 MIMAT0018199 | 2973 | AUAUGUAUAUGUGACUG CUACU | 2974 | AUAUGUAUAUGU GACUGCUA | 2975 | UCACAUAUACA UAU |
| hsa-miR-3925 MIMAT0018200 | 2976 | AAGAGAACUGAAAGUGG AGCCU | 2977 | AAGAGAACUGAA AGUGGAGC | 2978 | CUUUCAGUUCU CUU |
| hsa-miR-3926 MIMAT0018201 | 2979 | UGGCCAAAAAGCAGGCA GAGA | 2980 | UGGCCAAAAAGC AGGCAGAG | 2981 | CUGCUUUUUGG CCA |
| hsa-miR-3927 MIMAT0018202 | 2982 | CAGGUAGAUAUUUGAUA GGCAU | 2983 | CAGGUAGAUAUU UGAUAGGC | 2984 | CAAAUAUCUAC CUG |
| hsa-miR-3928 MIMAT0018205 | 2985 | GGAGGAACCUUGGAGCU UCGGC | 2986 | GGAGGAACCUUG GAGCUUCG | 2987 | UCCAAGGUUCC UCC |
| hsa-miR-3929 MIMAT0018206 | 2988 | GAGGCUGAUGUGAGUAG ACCACU | 2989 | GAGGCUGAUGUG AGUAGACC | 2990 | CUCACAUCAGC CUC |
| hsa-miR-3934 MIMAT0018349 | 2991 | UCAGGUGUGGAAACUGA GGCAG | 2992 | UCAGGUGUGGAA ACUGAGGC | 2993 | GUUUCCACACC UGA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-3935 MIMAT0018350 | 2994 | UGUAGAUACGAGCACCAGCCAC | 2995 | UGUAGAUACGAGCACCAGCC | 2996 | UGCUCGUAUCUACA |
| hsa-miR-3936 MIMAT0018351 | 2997 | UAAGGGGUGUAUGGCAGAUGCA | 2998 | UAAGGGGUGUAUGGCAGAUG | 2999 | CCAUACACCCCUUA |
| hsa-miR-3937 MIMAT0018352 | 3000 | ACAGGCGGCUGUAGCAAUGGGGG | 3001 | ACAGGCGGCUGUAGCAAUGG | 3002 | CUACAGCCGCCUGU |
| hsa-miR-3938 MIMAT0018353 | 3003 | AAUUCCCUUGUAGAUAACCCGG | 3004 | AAUUCCCUUGUAGAUAACCC | 3005 | UCUACAAGGGAAUU |
| hsa-miR-3939 MIMAT0018355 | 3006 | UACGCGCAGACCACAGGAUGUC | 3007 | UACGCGCAGACCACAGGAUG | 3008 | GUGGUCUGCGCGUA |
| hsa-miR-3940 MIMAT0018356 | 3009 | CAGCCCGGAUCCCAGCCCACUU | 3010 | CAGCCCGGAUCCCAGCCCAC | 3011 | UGGGAUCCGGGCUG |
| hsa-miR-3941 MIMAT0018357 | 3012 | UUACACACAACUGAGGAUCAUA | 3013 | UUACACACAACUGAGGAUCA | 3014 | UCAGUUGUGUUAA |
| hsa-miR-3942 MIMAT0018358 | 3015 | AAGCAAUACUGUUACCUGAAAU | 3016 | AAGCAAUACUGUUACCUGAA | 3017 | UAACAGUAUUGCUU |
| hsa-miR-3943 MIMAT0018359 | 3018 | UAGCCCCCAGGCUUCACUUGGCG | 3019 | UAGCCCCCAGGCUUCACUUG | 3020 | AAGCCUGGGGCUA |
| hsa-miR-3944 MIMAT0018360 | 3021 | UUCGGGCUGGCCUGCUGCUCCGG | 3022 | UUCGGGCUGGCCUGCUGCUC | 3023 | CAGGCCAGCCCGAA |
| hsa-miR-3945 MIMAT0018361 | 3024 | AGGGCAUAGGAGAGGGUUGAUAU | 3025 | AGGGCAUAGGAGAGGGUUGA | 3026 | CUCUCCUAUGCCCU |
| hsa-miR-409-3p MIMAT0001639 | 3027 | GAAUGUUGCUCGGUGAACCCCCU | 3028 | GAAUGUUGCUCGGUGAACCC | 3029 | ACCGAGCAACAUUC |
| hsa-miR-409-5p MIMAT0001638 | 3030 | AGGUUACCCGAGCAACUUUGCAU | 3031 | AGGUUACCCGAGCAACUUUG | 3032 | UGCUCGGGUAACCU |
| hsa-miR-410 MIMAT0002171 | 3033 | AAUAUAACACAGAUGGCCUGU | 3034 | AAUAUAACACAGAUGGCCUG | 3035 | AUCUGUGUUAUAUU |
| hsa-miR-411 MIMAT0003329 | 3036 | UAGUAGACCGUAUAGCGUACG | 3037 | UAGUAGACCGUAUAGCGUAC | 3038 | UAUACGGUCUACUA |
| hsa-miR-411* MIMAT0004813 | 3039 | UAUGUAACACGGUCCACUAACC | 3040 | UAUGUAACACGGUCCACUAA | 3041 | GACCGUGUUACAUA |
| hsa-miR-412 MIMAT0002170 | 3042 | ACUUCACCUGGUCCACUAGCCGU | 3043 | ACUUCACCUGGUCCACUAGC | 3044 | GGACCAGGUGAAGU |
| hsa-miR-421 MIMAT0003339 | 3045 | AUCAACAGACAUUAAUUGGGCGC | 3046 | AUCAACAGACAUUAAUUGGG | 3047 | UAAUGUCUGUUGAU |
| hsa-miR-422a MIMAT0001339 | 3048 | ACUGGACUUAGGGUCAGAAGGC | 3049 | ACUGGACUUAGGGUCAGAAG | 3050 | ACCCUAAGUCCAGU |
| hsa-miR-423-3p MIMAT0001340 | 3051 | AGCUCGGUCUGAGGCCCCUCAGU | 3052 | AGCUCGGUCUGAGGCCCCUC | 3053 | CCUCAGACCGAGCU |
| hsa-miR-423-5p MIMAT0004748 | 3054 | UGAGGGGCAGAGAGCGAGACUUU | 3055 | UGAGGGGCAGAGAGCGAGAC | 3056 | CUCUCUGCCCCUCA |
| hsa-miR-424 MIMAT0001341 | 3057 | CAGCAGCAAUUCAUGUUUUGAA | 3058 | CAGCAGCAAUUCAUGUUUUG | 3059 | AUGAAUUGCUGCUG |
| hsa-miR-424* MIMAT0004749 | 3060 | CAAAACGUGAGGCGCUGCUAU | 3061 | CAAAACGUGAGGCGCUGCUA | 3062 | CGCCUCACGUUUUG |
| hsa-miR-425 MIMAT0003393 | 3063 | AAUGACACGAUCACUCCCGUUGA | 3064 | AAUGACACGAUCACUCCCGU | 3065 | GUGAUCGUGUCAUU |
| hsa-miR-425* MIMAT0001343 | 3066 | AUCGGGAAUGUCGUGUCCGCCC | 3067 | AUCGGGAAUGUCGUGUCCGC | 3068 | ACGACAUUCCCGAU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-4251 MIMAT0016883 | 3069 | CCUGAGAAAAGGGCCAA | 3070 | CCUGAGAAAAGG GCCAA | 3071 | GCCCUUUUCUC AGG |
| hsa-miR-4252 MIMAT0016886 | 3072 | GGCCACUGAGUCAGCAC CA | 3073 | GGCCACUGAGUC AGCACCA | 3074 | CUGACUCAGUG GCC |
| hsa-miR-4253 MIMAT0016882 | 3075 | AGGGCAUGUCCAGGGGU | 3076 | AGGGCAUGUCCA GGGGGU | 3077 | CCUGGACAUGC CCU |
| hsa-miR-4254 MIMAT0016884 | 3078 | GCCUGGAGCUACUCCAC CAUCUC | 3079 | GCCUGGAGCUAC UCCACCAU | 3080 | GAGUAGCUCCA GGC |
| hsa-miR-4255 MIMAT0016885 | 3081 | CAGUGUUCAGAGAUGGA | 3082 | CAGUGUUCAGAG AUGGA | 3083 | AUCUCUGAACA CUG |
| hsa-miR-4256 MIMAT0016877 | 3084 | AUCUGACCUGAUGAAGGU | 3085 | AUCUGACCUGAU GAAGGU | 3086 | UCAUCAGGUCA GAU |
| hsa-miR-4257 MIMAT0016878 | 3087 | CCAGAGGUGGGGACUGAG | 3088 | CCAGAGGUGGGG ACUGAG | 3089 | GUCCCCACCUC UGG |
| hsa-miR-4258 MIMAT0016879 | 3090 | CCCCGCCACCGCCUUGG | 3091 | CCCCGCCACCGC CUUGG | 3092 | AGGCGGUGGCG GGG |
| hsa-miR-4259 MIMAT0016880 | 3093 | CAGUUGGGUCUAGGGGU CAGGA | 3094 | CAGUUGGGUCUA GGGGUCAG | 3095 | CCUAGACCCAA CUG |
| hsa-miR-4260 MIMAT0016881 | 3096 | CUUGGGGCAUGGAGUCC CA | 3097 | CUUGGGGCAUGG AGUCCCA | 3098 | CUCCAUGCCCC AAG |
| hsa-miR-4261 MIMAT0016890 | 3099 | AGGAAACAGGGACCCA | 3100 | AGGAAACAGGGA CCCA | 3101 | GGUCCCUGUUU CCU |
| hsa-miR-4262 MIMAT0016894 | 3102 | GACAUUCAGACUACCUG | 3103 | GACAUUCAGACU ACCUG | 3104 | GUAGUCUGAAU GUC |
| hsa-miR-4263 MIMAT0016898 | 3105 | AUUCUAAGUGCCUUGGCC | 3106 | AUUCUAAGUGCC UUGGCC | 3107 | AAGGCACUUAG AAU |
| hsa-miR-4264 MIMAT0016899 | 3108 | ACUCAGUCAUGGUCAUU | 3109 | ACUCAGUCAUGG UCAUU | 3110 | GACCAUGACUG AGU |
| hsa-miR-4265 MIMAT0016891 | 3111 | CUGUGGGCUCAGCUCUG GG | 3112 | CUGUGGGCUCAG CUCUGGG | 3113 | AGCUGAGCCCA CAG |
| hsa-miR-4266 MIMAT0016892 | 3114 | CUAGGAGGCCUUGGCC | 3115 | CUAGGAGGCCUU GGCC | 3116 | CCAAGGCCUCC UAG |
| hsa-miR-4267 MIMAT0016893 | 3117 | UCCAGCUCGGUGGCAC | 3118 | UCCAGCUCGGUG GCAC | 3119 | GCCACCGAGCU GGA |
| hsa-miR-4268 MIMAT0016896 | 3120 | GGCUCCUCCUCUCAGGA UGUG | 3121 | GGCUCCUCCUCU CAGGAUGU | 3122 | UGAGAGGAGGA GCC |
| hsa-miR-4269 MIMAT0016897 | 3123 | GCAGGCACAGACAGCCC UGGC | 3124 | GCAGGCACAGAC AGCCCUGG | 3125 | CUGUCUGUGCC UGC |
| hsa-miR-4270 MIMAT0016900 | 3126 | UCAGGGAGUCAGGGGAG GGC | 3127 | UCAGGGAGUCAG GGGAGGGC | 3128 | CCCUGACUCCC UGA |
| hsa-miR-4271 MIMAT0016901 | 3129 | GGGGGAAGAAAAGGUGG GG | 3130 | GGGGGAAGAAAA GGUGGGG | 3131 | CCUUUUCUUCC CCC |
| hsa-miR-4272 MIMAT0016902 | 3132 | CAUUCAACUAGUGAUUGU | 3133 | CAUUCAACUAGU GAUUGU | 3134 | UCACUAGUUGA AUG |
| hsa-miR-4273 MIMAT0016903 | 3135 | GUGUUCUCUGAUGGACAG | 3136 | GUGUUCUCUGAU GGACAG | 3137 | CCAUCAGAGAA CAC |
| hsa-miR-4274 MIMAT0016906 | 3138 | CAGCAGUCCCUCCCCCUG | 3139 | CAGCAGUCCCUC CCCCUG | 3140 | GGGAGGGACUG CUG |
| hsa-miR-4275 MIMAT0016905 | 3141 | CCAAUUACCACUUCUUU | 3142 | CCAAUUACCACU UCUUU | 3143 | GAAGUGGUAAU UGG |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-4276 MIMAT0016904 | 3144 | CUCAGUGACUCAUGUGC | 3145 | CUCAGUGACUCA UGUGC | 3146 | CAUGAGUCACU GAG |
| hsa-miR-4277 MIMAT0016908 | 3147 | GCAGUUCUGAGCACAGU ACAC | 3148 | GCAGUUCUGAGC ACAGUACA | 3149 | GUGCUCAGAAC UGC |
| hsa-miR-4278 MIMAT0016910 | 3150 | CUAGGGGGUUUGCCCUUG | 3151 | CUAGGGGGUUUG CCCUUG | 3152 | GGCAAACCCCC UAG |
| hsa-miR-4279 MIMAT0016909 | 3153 | CUCUCCUCCCGGCUUC | 3154 | CUCUCCUCCCGG CUUC | 3155 | AGCCGGGAGGA GAG |
| hsa-miR-4280 MIMAT0016911 | 3156 | GAGUGUAGUUCUGAGCA GAGC | 3157 | GAGUGUAGUUCU GAGCAGAG | 3158 | UCAGAACUACA CUC |
| hsa-miR-4281 MIMAT0016907 | 3159 | GGGUCCCGGGGAGGGGG | 3160 | GGGUCCCGGGGA GGGGGG | 3161 | CCUCCCCGGGA CCC |
| hsa-miR-4282 MIMAT0016912 | 3162 | UAAAAUUUGCAUCCAGGA | 3163 | UAAAAUUUGCAU CCAGGA | 3164 | GGAUGCAAAUU UUA |
| hsa-miR-4283 MIMAT0016914 | 3165 | UGGGGCUCAGCGAGUUU | 3166 | UGGGGCUCAGCG AGUUU | 3167 | CUCGCUGAGCC CCA |
| hsa-miR-4284 MIMAT0016915 | 3168 | GGGCUCACAUCACCCCAU | 3169 | GGGCUCACAUCA CCCCAU | 3170 | GGUGAUGUGAG CCC |
| hsa-miR-4285 MIMAT0016913 | 3171 | GCGGCGAGUCCGACUCAU | 3172 | GCGGCGAGUCCG ACUCAU | 3173 | GUCGGACUCGC CGC |
| hsa-miR-4286 MIMAT0016916 | 3174 | ACCCCACUCCUGGUACC | 3175 | ACCCCACUCCUG GUACC | 3176 | ACCAGGAGUGG GGU |
| hsa-miR-4287 MIMAT0016917 | 3177 | UCUCCCUUGAGGGCACU UU | 3178 | UCUCCCUUGAGG GCACUUU | 3179 | GCCCUCAAGGG AGA |
| hsa-miR-4288 MIMAT0016918 | 3180 | UUGUCUGCUGAGUUUCC | 3181 | UUGUCUGCUGAG UUUCC | 3182 | AACUCAGCAGA CAA |
| hsa-miR-4289 MIMAT0016920 | 3183 | GCAUUGUGCAGGGCUAU CA | 3184 | GCAUUGUGCAGG GCUAUCA | 3185 | GCCCUGCACAA UGC |
| hsa-miR-429 MIMAT0001536 | 3186 | UAAUACUGUCUGGUAAA ACCGU | 3187 | UAAUACUGUCUG GUAAAACC | 3188 | ACCAGACAGUA UUA |
| hsa-miR-4290 MIMAT0016921 | 3189 | UGCCCUCCUUUCUUCCC UC | 3190 | UGCCCUCCUUUC UUCCCUC | 3191 | AAGAAAGGAGG GCA |
| hsa-miR-4291 MIMAT0016922 | 3192 | UUCAGCAGGAACAGCU | 3193 | UUCAGCAGGAAC AGCU | 3194 | CUGUUCCUGCU GAA |
| hsa-miR-4292 MIMAT0016919 | 3195 | CCCCUGGGCCGGCCUUGG | 3196 | CCCCUGGGCCGG CCUUGG | 3197 | GGCCGGCCCAG GGG |
| hsa-miR-4293 MIMAT0016848 | 3198 | CAGCCUGACAGGAACAG | 3199 | CAGCCUGACAGG AACAG | 3200 | UUCCUGUCAGG CUG |
| hsa-miR-4294 MIMAT0016849 | 3201 | GGGAGUCUACAGCAGGG | 3202 | GGGAGUCUACAG CAGGG | 3203 | UGCUGUAGACU CCC |
| hsa-miR-4295 MIMAT0016844 | 3204 | CAGUGCAAUGUUUCCUU | 3205 | CAGUGCAAUGUU UUCCUU | 3206 | AAAACAUUGCA CUG |
| hsa-miR-4296 MIMAT0016845 | 3207 | AUGUGGGCUCAGGCUCA | 3208 | AUGUGGGCUCAG GCUCA | 3209 | GCCUGAGCCCA CAU |
| hsa-miR-4297 MIMAT0016846 | 3210 | UGCCUUCCUGUCUGUG | 3211 | UGCCUUCCUGUC UGUG | 3212 | CAGACAGGAAG GCA |
| hsa-miR-4298 MIMAT0016852 | 3213 | CUGGGACAGGAGGAGGA GGCAG | 3214 | CUGGGACAGGAG GAGGAGGC | 3215 | UCCUCCUGUCC CAG |
| hsa-miR-4299 MIMAT0016851 | 3216 | GCUGGUGACAUGAGAGGC | 3217 | GCUGGUGACAUG AGAGGC | 3218 | CUCAUGUCACC AGC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-4300 MIMAT0016853 | 3219 | UGGGAGCUGGACUACUUC | 3220 | UGGGAGCUGGAC UACUUC | 3221 | UAGUCCAGCUC CCA |
| hsa-miR-4301 MIMAT0016850 | 3222 | UCCCACUACUUCACUUG UGA | 3223 | UCCCACUACUUC ACUUGUGA | 3224 | GUGAAGUAGUG GGA |
| hsa-miR-4302 MIMAT0016855 | 3225 | CCAGUGUGGCUCAGCGAG | 3226 | CCAGUGUGGCUC AGCGAG | 3227 | CUGAGCCACAC UGG |
| hsa-miR-4303 MIMAT0016856 | 3228 | UUCUGAGCUGAGGACAG | 3229 | UUCUGAGCUGAG GACAG | 3230 | UCCUCAGCUCA GAA |
| hsa-miR-4304 MIMAT0016854 | 3231 | CCGGCAUGUCCAGGGCA | 3232 | CCGGCAUGUCCA GGGCA | 3233 | CCUGGACAUGC CGG |
| hsa-miR-4305 MIMAT0016857 | 3234 | CCUAGACACCUCCAGUUC | 3235 | CCUAGACACCUC CAGUUC | 3236 | UGGAGGUGUCU AGG |
| hsa-miR-4306 MIMAT0016858 | 3237 | UGGAGAGAAAGGCAGUA | 3238 | UGGAGAGAAAGG CAGUA | 3239 | UGCCUUUCUCU CCA |
| hsa-miR-4307 MIMAT0016860 | 3240 | AAUGUUUUUCCUGUUU CC | 3241 | AAUGUUUUUCC UGUUUCC | 3242 | CAGGAAAAAAC AUU |
| hsa-miR-4308 MIMAT0016861 | 3243 | UCCCUGGAGUUUCUUCUU | 3244 | UCCCUGGAGUUU CUUCUU | 3245 | AGAAACUCCAG GGA |
| hsa-miR-4309 MIMAT0016859 | 3246 | CUGGAGUCUAGGAUUCCA | 3247 | CUGGAGUCUAGG AUUCCA | 3248 | AUCCUAGACUC CAG |
| hsa-miR-431 MIMAT0001625 | 3249 | UGUCUUGCAGGCCGUCA UGCA | 3250 | UGUCUUGCAGGC CGUCAUGC | 3251 | CGGCCUGCAAG ACA |
| hsa-miR-431* MIMAT0004757 | 3252 | CAGGUCGUCUUGCAGGG CUUCU | 3253 | CAGGUCGUCUUG CAGGGCUU | 3254 | UGCAAGACGAC CUG |
| hsa-miR-4310 MIMAT0016862 | 3255 | GCAGCAUUCAUGUCCC | 3256 | GCAGCAUUCAUG UCCC | 3257 | GACAUGAAUGC UGC |
| hsa-miR-4311 MIMAT0016863 | 3258 | GAAAGAGAGCUGAGUGUG | 3259 | GAAAGAGAGCUG AGUGUG | 3260 | CUCAGCUCUCU UUC |
| hsa-miR-4312 MIMAT0016864 | 3261 | GGCCUUGUUCCUGUCCC CA | 3262 | GGCCUUGUUCCU GUCCCCA | 3263 | ACAGGAACAAG GCC |
| hsa-miR-4313 MIMAT0016865 | 3264 | AGCCCCCUGGCCCCAAA CCC | 3265 | AGCCCCCUGGCC CCAAACCC | 3266 | GGGGCCAGGGG GCU |
| hsa-miR-4314 MIMAT0016868 | 3267 | CUCUGGGAAAUGGGACAG | 3268 | CUCUGGGAAAUG GGACAG | 3269 | CCCAUUUCCCA GAG |
| hsa-miR-4315 MIMAT0016866 | 3270 | CCGCUUUCUGAGCUGGAC | 3271 | CCGCUUUCUGAG CUGGAC | 3272 | AGCUCAGAAAG CGG |
| hsa-miR-4316 MIMAT0016867 | 3273 | GGUGAGGCUAGCUGGUG | 3274 | GGUGAGGCUAGC UGGUG | 3275 | CAGCUAGCCUC ACC |
| hsa-miR-4317 MIMAT0016872 | 3276 | ACAUUGCCAGGGAGUUU | 3277 | ACAUUGCCAGGG AGUUU | 3278 | CUCCCUGGCAA UGU |
| hsa-miR-4318 MIMAT0016869 | 3279 | CACUGUGGGUACAUGCU | 3280 | CACUGUGGGUAC AUGCU | 3281 | AUGUACCCACA GUG |
| hsa-miR-4319 MIMAT0016870 | 3282 | UCCCUGAGCAAAGCCAC | 3283 | UCCCUGAGCAAA GCCAC | 3284 | GCUUUGCUCAG GGA |
| hsa-miR-432 MIMAT0002814 | 3285 | UCUUGGAGUAGGUCAUU GGUGG | 3286 | UCUUGGAGUAGG UCAUUGGG | 3287 | GACCUACUCCA AGA |
| hsa-miR-432* MIMAT0002815 | 3288 | CUGGAUGGCUCCUCCAU GUCU | 3289 | CUGGAUGGCUCC UCCAUGUC | 3290 | GAGGAGCCAUC CAG |
| hsa-miR-4320 MIMAT0016871 | 3291 | GGGAUUCUGUAGCUUCCU | 3292 | GGGAUUCUGUAG CUUCCU | 3293 | AGCUACAGAAU CCC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-4321 MIMAT0016874 | 3294 | UUAGCGGUGGACCGCCC UGCG | 3295 | UUAGCGGUGGAC CGCCCUGC | 3296 | CGGUCCACCGC UAA |
| hsa-miR-4322 MIMAT0016873 | 3297 | CUGUGGGCUCAGCGCGU GGGG | 3298 | CUGUGGGCUCAG CGCGUGGG | 3299 | CGCUGAGCCCA CAG |
| hsa-miR-4323 MIMAT0016875 | 3300 | CAGCCCCACAGCCUCAGA | 3301 | CAGCCCCACAGC CUCAGA | 3302 | AGGCUGUGGGG CUG |
| hsa-miR-4324 MIMAT0016876 | 3303 | CCCUGAGACCCUAACCU UAA | 3304 | CCCUGAGACCCU AACCUUAA | 3305 | UUAGGGUCUCA GGG |
| hsa-miR-4325 MIMAT0016887 | 3306 | UUGCACUUGUCUCAGUGA | 3307 | UUGCACUUGUCU CAGUGA | 3308 | UGAGACAAGUG CAA |
| hsa-miR-4326 MIMAT0016888 | 3309 | UGUUCCUCUGUCUCCCA GAC | 3310 | UGUUCCUCUGUC UCCCAGAC | 3311 | GAGACAGAGGA ACA |
| hsa-miR-4327 MIMAT0016889 | 3312 | GGCUUGCAUGGGGACU GG | 3313 | GGCUUGCAUGGG GGACUGG | 3314 | CCCCCAUGCAA GCC |
| hsa-miR-4328 MIMAT0016926 | 3315 | CCAGUUUUCCCAGGAUU | 3316 | CCAGUUUUCCCA GGAUU | 3317 | CCUGGGAAAAC UGG |
| hsa-miR-4329 MIMAT0016923 | 3318 | CCUGAGACCCUAGUUCC AC | 3319 | CCUGAGACCCUA GUUCCAC | 3320 | ACUAGGGUCUC AGG |
| hsa-miR-433 MIMAT0001627 | 3321 | AUCAUGAUGGGCUCCUC GGUGU | 3322 | AUCAUGAUGGGC UCCUCGGU | 3323 | GAGCCCAUCAU GAU |
| hsa-miR-4330 MIMAT0016924 | 3324 | CCUCAGAUCAGAGCCUU GC | 3325 | CCUCAGAUCAGA GCCUUGC | 3326 | GCUCUGAUCUG AGG |
| hsa-miR-448 MIMAT0001532 | 3327 | UUGCAUAUGUAGGAUGU CCCAU | 3328 | UUGCAUAUGUAG GAUGUCCC | 3329 | UCCUACAUAUG CAA |
| hsa-miR-449a MIMAT0001541 | 3330 | UGGCAGUGUAUUGUUAG CUGGU | 3331 | UGGCAGUGUAUU GUUAGCUG | 3332 | ACAAUACACUG CCA |
| hsa-miR-449b MIMAT0003327 | 3333 | AGGCAGUGUAUUGUUAG CUGGC | 3334 | AGGCAGUGUAUU GUUAGCUG | 3335 | ACAAUACACUG CCU |
| hsa-miR-449b* MIMAT0009203 | 3336 | CAGCCACAACUACCCUG CCACU | 3337 | CAGCCACAACUA CCCUGCCA | 3338 | GGUAGUUGUGG CUG |
| hsa-miR-449c MIMAT0010251 | 3339 | UAGGCAGUGUAUUGCUA GCGGCUGU | 3340 | UAGGCAGUGUAU UGCUAGCG | 3341 | CAAUACACUGC CUA |
| hsa-miR-449c* MIMAT0013771 | 3342 | UUGCUAGUUGCACUCCU CUCUGU | 3343 | UUGCUAGUUGCA CUCCUCUC | 3344 | AGUGCAACUAG CAA |
| hsa-miR-450a MIMAT0001545 | 3345 | UUUUGCGAUGUGUUCCU AAUAU | 3346 | UUUUGCGAUGUG UUCCUAAU | 3347 | AACACAUCGCA AAA |
| hsa-miR-450b-3p MIMAT0004910 | 3348 | UUGGGAUCAUUUUGCAU CCAUA | 3349 | UUGGGAUCAUUU UGCAUCCA | 3350 | CAAAAUGAUCC CAA |
| hsa-miR-450b-5p MIMAT0004909 | 3351 | UUUUGCAAUAUGUUCCU GAAUA | 3352 | UUUUGCAAUAUG UUCCUGAA | 3353 | AACAUAUUGCA AAA |
| hsa-miR-451 MIMAT0001631 | 3354 | AAACCGUUACCAUUACU GAGUU | 3355 | AAACCGUUACCA UUACUGAG | 3356 | AAUGGUAACGG UUU |
| hsa-miR-452 MIMAT0001635 | 3357 | AACUGUUUGCAGAGGAA ACUGA | 3358 | AACUGUUUGCAG AGGAAACU | 3359 | CUCUGCAAACA GUU |
| hsa-miR-452* MIMAT0001636 | 3360 | CUCAUCUGCAAAGAAGU AAGUG | 3361 | CUCAUCUGCAAA GAAGUAAG | 3362 | UCUUUGCAGAU GAG |
| hsa-miR-454 MIMAT0003885 | 3363 | UAGUGCAAUAUUGCUUA UAGGGU | 3364 | UAGUGCAAUAUU GCUUAUAG | 3365 | GCAAUAUUGCA CUA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-454* MIMAT0003884 | 3366 | ACCCUAUCAAUAUUGUCUCUGC | 3367 | ACCCUAUCAAUAUUGUCUCU | 3368 | AAUAUUGAUAGGGU |
| hsa-miR-455-3p MIMAT0004784 | 3369 | GCAGUCCAUGGGCAUAUACAC | 3370 | GCAGUCCAUGGGCAUAUACA | 3371 | UGCCCAUGGACUGC |
| hsa-miR-455-5p MIMAT0003150 | 3372 | UAUGUGCCUUUGGACUACAUCG | 3373 | UAUGUGCCUUUGGACUACAU | 3374 | UCCAAAGGCACAUA |
| hsa-miR-466 MIMAT0015002 | 3375 | AUACACAUACACGCAACACACAU | 3376 | AUACACAUACACGCAACACA | 3377 | GCGUGUAUGUGUAU |
| hsa-miR-483-3p MIMAT0002173 | 3378 | UCACUCCUCUCCUCCCGUCUU | 3379 | UCACUCCUCUCCUCCCGUCU | 3380 | GAGGAGAGGAGUGA |
| hsa-miR-483-5p MIMAT0004761 | 3381 | AAGACGGGAGGAAAGAAGGGAG | 3382 | AAGACGGGAGGAAAGAAGGG | 3383 | UUUCCUCCCGUCUU |
| hsa-miR-484 MIMAT0002174 | 3384 | UCAGGCUCAGUCCCCUCCCGAU | 3385 | UCAGGCUCAGUCCCCUCCCG | 3386 | GGGACUGAGCCUGA |
| hsa-miR-485-3p MIMAT0002176 | 3387 | GUCAUACACGGCUCUCCUCUCU | 3388 | GUCAUACACGGCUCUCCUCU | 3389 | GAGCCGUGUAUGAC |
| hsa-miR-485-5p MIMAT0002175 | 3390 | AGAGGCUGGCCGUGAUGAAUUC | 3391 | AGAGGCUGGCCGUGAUGAAU | 3392 | CACGGCCAGCCUCU |
| hsa-miR-486-3p MIMAT0004762 | 3393 | CGGGGCAGCUCAGUACAGGAU | 3394 | CGGGGCAGCUCAGUACAGGA | 3395 | ACUGAGCUGCCCCG |
| hsa-miR-486-5p MIMAT0002177 | 3396 | UCCUGUACUGAGCUGCCCCGAG | 3397 | UCCUGUACUGAGCUGCCCCG | 3398 | AGCUCAGUACAGGA |
| hsa-miR-487a MIMAT0002178 | 3399 | AAUCAUACAGGGACAUCCAGUU | 3400 | AAUCAUACAGGGACAUCCAG | 3401 | GUCCCUGUAUGAUU |
| hsa-miR-487b MIMAT0003180 | 3402 | AAUCGUACAGGGUCAUCCACUU | 3403 | AAUCGUACAGGGUCAUCCAC | 3404 | GACCCUGUACGAUU |
| hsa-miR-488 MIMAT0004763 | 3405 | UUGAAAGGCUAUUUCUUGGUC | 3406 | UUGAAAGGCUAUUUCUUGGU | 3407 | AAAUAGCCUUUCAA |
| hsa-miR-488* MIMAT0002804 | 3408 | CCCAGAUAAUGGCACUCUCAA | 3409 | CCCAGAUAAUGGCACUCUCA | 3410 | UGCCAUUAUCUGGG |
| hsa-miR-489 MIMAT0002805 | 3411 | GUGACAUCACAUAUACGGCAGC | 3412 | GUGACAUCACAUAUACGGCA | 3413 | AUAUGUGAUGUCAC |
| hsa-miR-490-3p MIMAT0002806 | 3414 | CAACCUGGAGGACUCCAUGCUG | 3415 | CAACCUGGAGGACUCCAUGC | 3416 | AGUCCUCCAGGUUG |
| hsa-miR-490-5p MIMAT0004764 | 3417 | CCAUGGAUCUCCAGGUGGGU | 3418 | CCAUGGAUCUCCAGGUGGGU | 3419 | CUGGAGAUCCAUGG |
| hsa-miR-491-3p MIMAT0004765 | 3420 | CUUAUGCAAGAUUCCCUUCUAC | 3421 | CUUAUGCAAGAUUCCCUUCU | 3422 | GAAUCUUGCAUAAG |
| hsa-miR-491-5p MIMAT0002807 | 3423 | AGUGGGGAACCCUUCCAUGAGG | 3424 | AGUGGGGAACCCUUCCAUGA | 3425 | AAGGGUUCCCCACU |
| hsa-miR-492 MIMAT0002812 | 3426 | AGGACCUGCGGGACAAGAUUCUU | 3427 | AGGACCUGCGGGACAAGAUU | 3428 | GUCCCGCAGGUCCU |
| hsa-miR-493 MIMAT0003161 | 3429 | UGAAGGUCUACUGUGUGCCAGG | 3430 | UGAAGGUCUACUGUGUGCCA | 3431 | ACAGUAGACCUUCA |
| hsa-miR-493* MIMAT0002813 | 3432 | UUGUACAUGGUAGGCUUUCAUU | 3433 | UUGUACAUGGUAGGCUUUCA | 3434 | CCUACCAUGUACAA |
| hsa-miR-494 MIMAT0002816 | 3435 | UGAAACAUACACGGGAAACCUC | 3436 | UGAAACAUACACGGGAAACC | 3437 | CCGUGUAUGUUUCA |
| hsa-miR-495 MIMAT0002817 | 3438 | AAACAAACAUGGUGCACUUCUU | 3439 | AAACAAACAUGGUGCACUUC | 3440 | CACCAUGUUUGUUU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-496 MIMAT0002818 | 3441 | UGAGUAUUACAUGGCCA AUCUC | 3442 | UGAGUAUUACAU GGCCAAUC | 3443 | CCAUGUAAUAC UCA |
| hsa-miR-497 MIMAT0002820 | 3444 | CAGCAGCACACUGUGGU UUGU | 3445 | CAGCAGCACACU GUGGUUUG | 3446 | ACAGUGUGCUG CUG |
| hsa-miR-497* MIMAT0004768 | 3447 | CAAACCACACUGUGGUG UUAGA | 3448 | CAAACCACACUG UGGUGUUA | 3449 | CACAGUGUGGU UUG |
| hsa-miR-498 MIMAT0002824 | 3450 | UUUCAAGCCAGGGGGCG UUUUUC | 3451 | UUUCAAGCCAGG GGGCGUUU | 3452 | CCCCUGGCUUG AAA |
| hsa-miR-499-3p MIMAT0004772 | 3453 | AACAUCACAGCAAGUCU GUGCU | 3454 | AACAUCACAGCA AGUCUGUG | 3455 | CUUGCUGUGAU GUU |
| hsa-miR-499-5p MIMAT0002870 | 3456 | UUAAGACUUGCAGUGAU GUUU | 3457 | UUAAGACUUGCA GUGAUGUU | 3458 | ACUGCAAGUCU UAA |
| hsa-miR-500a MIMAT0004773 | 3459 | UAAUCCUUGCUACCUGG GUGAGA | 3460 | UAAUCCUUGCUA CCUGGGUG | 3461 | GGUAGCAAGGA UUA |
| hsa-miR-500a* MIMAT0002871 | 3462 | AUGCACCUGGGCAAGGA UUCUG | 3463 | AUGCACCUGGGC AAGGAUUC | 3464 | UUGCCCAGGUG CAU |
| hsa-miR-500b MIMAT0016925 | 3465 | AAUCCUUGCUACCUGGGU | 3466 | AAUCCUUGCUAC CUGGGU | 3467 | AGGUAGCAAGG AUU |
| hsa-miR-501-3p MIMAT0004774 | 3468 | AAUGCACCCGGGCAAGG AUUCU | 3469 | AAUGCACCCGGG CAAGGAUU | 3470 | UGCCCGGGUGC AUU |
| hsa-miR-501-5p MIMAT0002872 | 3471 | AAUCCUUUGUCCCUGGG UGAGA | 3472 | AAUCCUUUGUCC CUGGGUGA | 3473 | AGGGACAAAGG AUU |
| hsa-miR-502-3p MIMAT0004775 | 3474 | AAUGCACCUGGGCAAGG AUUCA | 3475 | AAUGCACCUGGG CAAGGAUU | 3476 | UGCCCAGGUGC AUU |
| hsa-miR-502-5p MIMAT0002873 | 3477 | AUCCUUGCUAUCUGGGU GCUA | 3478 | AUCCUUGCUAUC UGGGUGCU | 3479 | CAGAUAGCAAG GAU |
| hsa-miR-503 MIMAT0002874 | 3480 | UAGCAGCGGGAACAGUU CUGCAG | 3481 | UAGCAGCGGGAA CAGUUCUG | 3482 | UGUUCCCGCUG CUA |
| hsa-miR-504 MIMAT0002875 | 3483 | AGACCCUGGUCUGCACU CUAUC | 3484 | AGACCCUGGUCU GCACUCUA | 3485 | GCAGACCAGGG UCU |
| hsa-miR-505 MIMAT0002876 | 3486 | CGUCAACACUUGCUGGU UUCCU | 3487 | CGUCAACACUUG CUGGUUUC | 3488 | AGCAAGUGUUG ACG |
| hsa-miR-505* MIMAT0004776 | 3489 | GGGAGCCAGGAAGUAUU GAUGU | 3490 | GGGAGCCAGGAA GUAUUGAU | 3491 | ACUUCCUGGCU CCC |
| hsa-miR-506 MIMAT0002878 | 3492 | UAAGGCACCCUUCUGAG UAGA | 3493 | UAAGGCACCCUU CUGAGUAG | 3494 | AGAAGGGUGCC UUA |
| hsa-miR-507 MIMAT0002879 | 3495 | UUUUGCACCUUUUGGAG UGAA | 3496 | UUUUGCACCUUU UGGAGUGA | 3497 | CAAAAGGUGCA AAA |
| hsa-miR-508-3p MIMAT0002880 | 3498 | UGAUUGUAGCCUUUUGG AGUAGA | 3499 | UGAUUGUAGCCU UUUGGAGU | 3500 | AAAGGCUACAA UCA |
| hsa-miR-508-5p MIMAT0004778 | 3501 | UACUCCAGAGGGCGUCA CUCAUG | 3502 | UACUCCAGAGGG CGUCACUC | 3503 | CGCCCUCUGGA GUA |
| hsa-miR-509-3-5p MIMAT0004975 | 3504 | UACUGCAGACGUGGCAA UCAUG | 3505 | UACUGCAGACGU GGCAAUCA | 3506 | CCACGUCUGCA GUA |
| hsa-miR-509-3p MIMAT0002881 | 3507 | UGAUUGGUACGUCUGUG GGUAG | 3508 | UGAUUGGUACGU CUGUGGGU | 3509 | AGACGUACCAA UCA |
| hsa-miR-509-5p MIMAT0004779 | 3510 | UACUGCAGACAGUGGCA AUCA | 3511 | UACUGCAGACAG UGGCAAUC | 3512 | CACUGUCUGCA GUA |
| hsa-miR-510 MIMAT0002882 | 3513 | UACUCAGGAGAGUGGCA AUCAC | 3514 | UACUCAGGAGAG UGGCAAUC | 3515 | CACUCUCCUGA GUA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-511 MIMAT0002808 | 3516 | GUGUCUUUUGCUCUGCA GUCA | 3517 | GUGUCUUUUGCU CUGCAGUC | 3518 | AGAGCAAAAGA CAC |
| hsa-miR-512-3p MIMAT0002823 | 3519 | AAGUGCUGUCAUAGCUG AGGUC | 3520 | AAGUGCUGUCAU AGCUGAGG | 3521 | CUAUGACAGCA CUU |
| hsa-miR-512-5p MIMAT0002822 | 3522 | CACUCAGCCUUGAGGGC ACUUUC | 3523 | CACUCAGCCUUG AGGGCACU | 3524 | CUCAAGGCUGA GUG |
| hsa-miR-513a-3p MIMAT0004777 | 3525 | UAAAUUUCACCUUUCUG AGAAGG | 3526 | UAAAUUUCACCU UUCUGAGA | 3527 | AAAGGUGAAAU UUA |
| hsa-miR-513a-5p MIMAT0002877 | 3528 | UUCACAGGGAGGUGUCAU | 3529 | UUCACAGGGAGG UGUCAU | 3530 | CACCUCCCUGU GAA |
| hsa-miR-513b MIMAT0005788 | 3531 | UUCACAAGGAGGUGUCA UUUAU | 3532 | UUCACAAGGAGG UGUCAUUU | 3533 | CACCUCCUUGU GAA |
| hsa-miR-513c MIMAT0005789 | 3534 | UUCUCAAGGAGGUGUCG UUUAU | 3535 | UUCUCAAGGAGG UGUCGUUU | 3536 | CACCUCCUUGA GAA |
| hsa-miR-514 MIMAT0002883 | 3537 | AUUGACACUUCUGUGAG UAGA | 3538 | AUUGACACUUCU GUGAGUAG | 3539 | ACAGAAGUGUC AAU |
| hsa-miR-514b-3p MIMAT0015088 | 3540 | AUUGACACUUCUGUGAG UGGA | 3541 | AUUGACACCUCU GUGAGUGG | 3542 | ACAGAGGUGUC AAU |
| hsa-miR-514b-5p MIMAT0015087 | 3543 | UUCUCAAGAGGGAGGCA AUCAU | 3544 | UUCUCAAGAGGG AGGCAAUC | 3545 | CUCCCUCUUGA GAA |
| hsa-miR-515-3p MIMAT0002827 | 3546 | GAGUGCCUUCUUUUGGA GCGUU | 3547 | GAGUGCCUUCUU UUGGAGCG | 3548 | AAAAGAAGGCA CUC |
| hsa-miR-515-5p MIMAT0002826 | 3549 | UUCUCCAAAAGAAAGCA CUUUCUG | 3550 | UUCUCCAAAAGA AAGCACUU | 3551 | UUUCUUUUGGA GAA |
| hsa-miR-516a-3p MIMAT0006778 | 3552 | UGCUUCCUUUCAGAGGGU | 3553 | UGCUUCCUUUCA GAGGGU | 3554 | UCUGAAAGGAA GCA |
| hsa-miR-516a-5p MIMAT0004770 | 3555 | UUCUCGAGGAAAGAAGC ACUUUC | 3556 | UUCUCGAGGAAA GAAGCACU | 3557 | UCUUCCUCGA GAA |
| hsa-miR-516b MIMAT0002859 | 3558 | AUCUGGAGGUAAGAAGC ACUUU | 3559 | AUCUGGAGGUAA GAAGCACU | 3560 | UCUUACCUCCA GAU |
| hsa-miR-516b* MIMAT0002860 | 3561 | UGCUUCCUUUCAGAGGGU | 3562 | UGCUUCCUUUCA GAGGGU | 3563 | UCUGAAAGGAA GCA |
| hsa-miR-517* MIMAT0002851 | 3564 | CCUCUAGAUGGAAGCAC UGUCU | 3565 | CCUCUAGAUGGA AGCACUGU | 3566 | CUUCCAUCUAG AGG |
| hsa-miR-517a MIMAT0002852 | 3567 | AUCGUGCAUCCCUUUAG AGUGU | 3568 | AUCGUGCAUCCC UUUAGAGU | 3569 | AAGGGAUGCAC GAU |
| hsa-miR-517b MIMAT0002857 | 3570 | UCGUGCAUCCCUUUAGA GUGUU | 3571 | UCGUGCAUCCCU UUAGAGUG | 3572 | AAAGGGAUGCA CGA |
| hsa-miR-517c MIMAT0002866 | 3573 | AUCGUGCAUCCUUUUAG AGUGU | 3574 | AUCGUGCAUCCU UUUAGAGU | 3575 | AAAGGAUGCAC GAU |
| hsa-miR-518a-3p MIMAT0002863 | 3576 | GAAAGCGCUUCCCUUUG CUGGA | 3577 | GAAAGCGCUUCC CUUUGCUG | 3578 | AGGGAAGCGCU UUC |
| hsa-miR-518a-5p MIMAT0005457 | 3579 | CUGCAAAGGGAAGCCCU UUC | 3580 | CUGCAAAGGGAA GCCCUUUC | 3581 | GCUUCCCUUUG CAG |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-518b MIMAT0002844 | 3582 | CAAAGCGCUCCCCUUUA GAGGU | 3583 | CAAAGCGCUCCC CUUUAGAG | 3584 | AGGGGAGCGCU UUG |
| hsa-miR-518c MIMAT0002848 | 3585 | CAAAGCGCUUCUCUUUA GAGUGU | 3586 | CAAAGCGCUUCU CUUUAGAG | 3587 | AGAGAAGCGCU UUG |
| hsa-miR-518c* MIMAT0002847 | 3588 | UCUCUGGAGGGAAGCAC UUUCUG | 3589 | UCUCUGGAGGGA AGCACUUU | 3590 | CUUCCCUCCAG AGA |
| hsa-miR-518d-3p MIMAT0002864 | 3591 | CAAAGCGCUUCCCUUUG GAGC | 3592 | CAAAGCGCUUCC CUUUGGAG | 3593 | AGGGAAGCGCU UUG |
| hsa-miR-518d-5p MIMAT0005456 | 3594 | CUCUAGAGGGAAGCACU UUCUG | 3595 | CUCUAGAGGGAA GCACUUUC | 3596 | GCUUCCCUCUA GAG |
| hsa-miR-518e MIMAT0002861 | 3597 | AAAGCGCUUCCCUUCAG AGUG | 3598 | AAAGCGCUUCCC UUCAGAGU | 3599 | AAGGGAAGCGC UUU |
| hsa-miR-518e* MIMAT0005450 | 3600 | CUCUAGAGGGAAGCGCU UUCUG | 3601 | CUCUAGAGGGAA GCGCUUUC | 3602 | GCUUCCCUCUA GAG |
| hsa-miR-518f MIMAT0002842 | 3603 | GAAAGCGCUUCUCUUUA GAGG | 3604 | GAAAGCGCUUCU CUUUAGAG | 3605 | AGAGAAGCGCU UUC |
| hsa-miR-518f* MIMAT0002841 | 3606 | CUCUAGAGGGAAGCACU UUCUC | 3607 | CUCUAGAGGGAA GCACUUUC | 3608 | GCUUCCCUCUA GAG |
| hsa-miR-519a MIMAT0002869 | 3609 | AAAGUGCAUCCUUUUAG AGUGU | 3610 | AAAGUGCAUCCU UUUAGAGU | 3611 | AAAGGAUGCAC UUU |
| hsa-miR-519a* MIMAT0005452 | 3612 | CUCUAGAGGGAAGCGCU UUCUG | 3613 | CUCUAGAGGGAA GCGCUUUC | 3614 | GCUUCCCUCUA GAG |
| hsa-miR-519b-3p MIMAT0002837 | 3615 | AAAGUGCAUCCUUUUAG AGGUU | 3616 | AAAGUGCAUCCU UUUAGAGG | 3617 | AAAGGAUGCAC UUU |
| hsa-miR-519b-5p MIMAT0005454 | 3618 | CUCUAGAGGGAAGCGCU UUCUG | 3619 | CUCUAGAGGGAA GCGCUUUC | 3620 | GCUUCCCUCUA GAG |
| hsa-miR-519c-3p MIMAT0002832 | 3621 | AAAGUGCAUCUUUUUAG AGGAU | 3622 | AAAGUGCAUCUU UUUAGAGG | 3623 | AAAAGAUGCAC UUU |
| hsa-miR-519c-5p MIMAT0002831 | 3624 | CUCUAGAGGGAAGCGCU UUCUG | 3625 | CUCUAGAGGGAA GCGCUUUC | 3626 | GCUUCCCUCUA GAG |
| hsa-miR-519d MIMAT0002853 | 3627 | CAAAGUGCCUCCCUUUA GAGUG | 3628 | CAAAGUGCCUCC CUUUAGAG | 3629 | AGGGAGGCACU UUG |
| hsa-miR-519e MIMAT0002829 | 3630 | AAGUGCCUCCUUUUAGA GUGUU | 3631 | AAGUGCCUCCUU UUAGAGUG | 3632 | AAAAGGAGGCA CUU |
| hsa-miR-519e* MIMAT0002828 | 3633 | UUCUCCAAAAGGGAGCA CUUUC | 3634 | UUCUCCAAAAGG GAGCACUU | 3635 | UCCCUUUUGGA GAA |
| hsa-miR-520a-3p MIMAT0002834 | 3636 | AAAGUGCUUCCCUUUGG ACUGU | 3637 | AAAGUGCUUCCC UUUGGACU | 3638 | AAGGGAAGCAC UUU |
| hsa-miR-520a-5p MIMAT0002833 | 3639 | CUCCAGAGGGAAGUACU UUCU | 3640 | CUCCAGAGGGAA GUACUUUC | 3641 | ACUUCCCUCUG GAG |
| hsa-miR-520b MIMAT0002843 | 3642 | AAAGUGCUUCCUUUUAG AGGG | 3643 | AAAGUGCUUCCU UUUAGAGG | 3644 | AAAGGAAGCAC UUU |
| hsa-miR-520c-3p MIMAT0002846 | 3645 | AAAGUGCUUCCUUUUAG AGGGU | 3646 | AAAGUGCUUCCU UUUAGAGG | 3647 | AAAGGAAGCAC UUU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-520c-5p MIMAT0005455 | 3648 | CUCUAGAGGGAAGCACU UUCUG | 3649 | CUCUAGAGGGAA GCACUUUC | 3650 | GCUUCCCUCUA GAG |
| hsa-miR-520d-3p MIMAT0002856 | 3651 | AAAGUGCUUCUCUUUGG UGGGU | 3652 | AAAGUGCUUCUC UUUGGUGG | 3653 | AAGAGAAGCAC UUU |
| hsa-miR-520d-5p MIMAT0002855 | 3654 | CUACAAAGGGAAGCCCU UUC | 3655 | CUACAAAGGGAA GCCCUUUC | 3656 | GCUUCCCUUUG UAG |
| hsa-miR-520e MIMAT0002825 | 3657 | AAAGUGCUUCCUUUUUG AGGG | 3658 | AAAGUGCUUCCU UUUUGAGG | 3659 | AAAGGAAGCAC UUU |
| hsa-miR-520f MIMAT0002830 | 3660 | AAGUGCUUCCUUUUAGA GGGUU | 3661 | AAGUGCUUCCUU UUAGAGGG | 3662 | AAAAGGAAGCA CUU |
| hsa-miR-520g MIMAT0002858 | 3663 | ACAAAGUGCUUCCCUUU AGAGUGU | 3664 | ACAAAGUGCUUC CCUUUAGA | 3665 | GGGAAGCACUU UGU |
| hsa-miR-520h MIMAT0002867 | 3666 | ACAAAGUGCUUCCCUUU AGAGU | 3667 | ACAAAGUGCUUC CCUUUAGA | 3668 | GGGAAGCACUU UGU |
| hsa-miR-521 MIMAT0002854 | 3669 | AACGCACUUCCCUUUAG AGUGU | 3670 | AACGCACUUCCC UUUAGAGU | 3671 | AAGGGAAGUGC GUU |
| hsa-miR-522 MIMAT0002868 | 3672 | AAAAUGGUUCCCUUUAG AGUGU | 3673 | AAAAUGGUUCCC UUUAGAGU | 3674 | AAGGGAACCAU UUU |
| hsa-miR-522* MIMAT0005451 | 3675 | CUCUAGAGGGAAGCGCU UUCUG | 3676 | CUCUAGAGGGAA GCGCUUUC | 3677 | GCUUCCCUCUA GAG |
| hsa-miR-523 MIMAT0002840 | 3678 | GAACGCGCUUCCCUAUA GAGGGU | 3679 | GAACGCGCUUCC CUAUAGAG | 3680 | AGGGAAGCGCG UUC |
| hsa-miR-523* MIMAT0005449 | 3681 | CUCUAGAGGGAAGCGCU UUCUG | 3682 | CUCUAGAGGGAA GCGCUUUC | 3683 | GCUUCCCUCUA GAG |
| hsa-miR-524-3p MIMAT0002850 | 3684 | GAAGGCGCUUCCCUUUG GAGU | 3685 | GAAGGCGCUUCC CUUUGGAG | 3686 | AGGGAAGCGCC UUC |
| hsa-miR-524-5p MIMAT0002849 | 3687 | CUACAAAGGGAAGCACU UUCUC | 3688 | CUACAAAGGGAA GCACUUUC | 3689 | GCUUCCCUUUG UAG |
| hsa-miR-525-3p MIMAT0002839 | 3690 | GAAGGCGCUUCCCUUUA GAGCG | 3691 | GAAGGCGCUUCC CUUUAGAG | 3692 | AGGGAAGCGCC UUC |
| hsa-miR-525-5p MIMAT0002838 | 3693 | CUCCAGAGGGAUGCACU UUCU | 3694 | CUCCAGAGGGAU GCACUUUC | 3695 | GCAUCCCUCUG GAG |
| hsa-miR-526a MIMAT0002845 | 3696 | CUCUAGAGGGAAGCACU UUCUG | 3697 | CUCUAGAGGGAA GCACUUUC | 3698 | GCUUCCCUCUA GAG |
| hsa-miR-526b MIMAT0002835 | 3699 | CUCUUGAGGGAAGCACU UUCUGU | 3700 | CUCUUGAGGGAA GCACUUUC | 3701 | GCUUCCCUCAA GAG |
| hsa-miR-526b* MIMAT0002836 | 3702 | GAAAGUGCUUCCUUUUA GAGGC | 3703 | GAAAGUGCUUCC UUUUAGAG | 3704 | AAGGAAGCACU UUC |
| hsa-miR-527 MIMAT0002862 | 3705 | CUGCAAAGGGAAGCCCU UUC | 3706 | CUGCAAAGGGAA GCCCUUUC | 3707 | GCUUCCCUUUG CAG |
| hsa-miR-532-3p MIMAT0004780 | 3708 | CCUCCCACACCCAAGGC UUGCA | 3709 | CCUCCCACACCC AAGGCUUG | 3710 | UUGGGUGUGGG AGG |
| hsa-miR-532-5p MIMAT0002888 | 3711 | CAUGCCUUGAGUGUAGG ACCGU | 3712 | CAUGCCUUGAGU GUAGGACC | 3713 | ACACUCAAGGC AUG |
| hsa-miR-539 MIMAT0003163 | 3714 | GGAGAAAUUAUCCUUGG UGUGU | 3715 | GGAGAAAUUAUC CUUGGUGU | 3716 | AGGAUAAUUUC UCC |
| hsa-miR-541 MIMAT0004920 | 3717 | UGGUGGGCACAGAAUCU GGACU | 3718 | UGGUGGGCACAG AAUCUGGA | 3719 | UUCUGUGCCCA CCA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-541* MIMAT0004919 | 3720 | AAAGGAUUCUGCUGUCG GUCCCACU | 3721 | AAAGGAUUCUGC UGUCGGUC | 3722 | CAGCAGAAUCC UUU |
| hsa-miR-542-3p MIMAT0003389 | 3723 | UGUGACAGAUUGAUAAC UGAAA | 3724 | UGUGACAGAUUG AUAACUGA | 3725 | AUCAAUCUGUC ACA |
| hsa-miR-542-5p MIMAT0003340 | 3726 | UCGGGGAUCAUCAUGUC ACGAGA | 3727 | UCGGGGAUCAUC AUGUCACG | 3728 | AUGAUGAUCCC CGA |
| hsa-miR-543 MIMAT0004954 | 3729 | AAACAUUCGCGGUGCAC UUCUU | 3730 | AAACAUUCGCGG UGCACUUC | 3731 | CACCGCGAAUG UUU |
| hsa-miR-544 MIMAT0003164 | 3732 | AUUCUGCAUUUUUAGCA AGUUC | 3733 | AUUCUGCAUUUU UAGCAAGU | 3734 | UAAAAAUGCAG AAU |
| hsa-miR-544b MIMAT0015004 | 3735 | ACCUGAGGUUGUGCAUU UCUAA | 3736 | ACCUGAGGUUGU GCAUUUCU | 3737 | GCACAACCUCA GGU |
| hsa-miR-545 MIMAT0003165 | 3738 | UCAGCAAACAUUUAUUG UGUGC | 3739 | UCAGCAAACAUU UAUUGUGU | 3740 | UAAAUGUUUGC UGA |
| hsa-miR-545* MIMAT0004785 | 3741 | UCAGUAAAUGUUUAUUA GAUGA | 3742 | UCAGUAAAUGUU UAUUAGAU | 3743 | UAAACAUUUAC UGA |
| hsa-miR-548a-3p MIMAT0003251 | 3744 | CAAAACUGGCAAUUACU UUUGC | 3745 | CAAAACUGGCAA UUACUUUU | 3746 | AAUUGCCAGUU UUG |
| hsa-miR-548a-5p MIMAT0004803 | 3747 | AAAAGUAAUUGCGAGUU UUACC | 3748 | AAAAGUAAUUGC GAGUUUUA | 3749 | UCGCAAUUACU UUU |
| hsa-miR-548aa MIMAT0018447 | 3750 | AAAAACCACAAUUACUU UUGCACCA | 3751 | AAAAACCACAAU UACUUUUG | 3752 | UAAUUGUGGUU UUU |
| hsa-miR-548b-3p MIMAT0003254 | 3753 | CAAGAACCUCAGUUGCU UUUGU | 3754 | CAAGAACCUCAG UUGCUUUU | 3755 | AACUGAGGUUC UUG |
| hsa-miR-548b-5p MIMAT0004798 | 3756 | AAAAGUAAUUGUGGUUU UGGCC | 3757 | AAAAGUAAUUGU GGUUUUGG | 3758 | CCACAAUUACU UUU |
| hsa-miR-548c-3p MIMAT0003285 | 3759 | CAAAAAUCUCAAUUACU UUUGC | 3760 | CAAAAAUCUCAA UUACUUUU | 3761 | AAUUGAGAUUU UUG |
| hsa-miR-548c-5p MIMAT0004806 | 3762 | AAAAGUAAUUGCGGUUU UUGCC | 3763 | AAAAGUAAUUGC GGUUUUUG | 3764 | CCGCAAUUACU UUU |
| hsa-miR-548d-3p MIMAT0003323 | 3765 | CAAAAACCACAGUUUCU UUUGC | 3766 | CAAAAACCACAG UUUCUUUU | 3767 | AACUGUGGUUU UUG |
| hsa-miR-548d-5p MIMAT0004812 | 3768 | AAAAGUAAUUGUGGUUU UUGCC | 3769 | AAAAGUAAUUGU GGUUUUUG | 3770 | CCACAAUUACU UUU |
| hsa-miR-548e MIMAT0005874 | 3771 | AAAAACUGAGACUACUU UUGCA | 3772 | AAAAACUGAGAC UACUUUUG | 3773 | UAGUCUCAGUU UUU |
| hsa-miR-548f MIMAT0005895 | 3774 | AAAAACUGUAAUUACUU UU | 3775 | AAAAACUGUAAU UACUUUU | 3776 | UAAUUACAGUU UUU |
| hsa-miR-548g MIMAT0005912 | 3777 | AAACUGUAAUUACUUUU UGUAC | 3778 | AAACUGUAAUU ACUUUUGU | 3779 | GUAAUUACAGU UUU |
| hsa-miR-548h MIMAT0005928 | 3780 | AAAGUAAUCGCGGUUU UUGUC | 3781 | AAAAGUAAUCGC GGUUUUUG | 3782 | CCGCGAUUACU UUU |
| hsa-miR-548i MIMAT0005935 | 3783 | AAAAGUAAUUGCGGAUU UUGCC | 3784 | AAAAGUAAUUGC GGAUUUUG | 3785 | CCGCAAUUACU UUU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-548j MIMAT0005875 | 3786 | AAAAGUAAUUGCGGUCU UUGGU | 3787 | AAAAGUAAUUGC GGUCUUUG | 3788 | CCGCAAUUACU UUU |
| hsa-miR-548k MIMAT0005882 | 3789 | AAAAGUACUUGCGGAUU UUGCU | 3790 | AAAAGUACUUGC GGAUUUUG | 3791 | CCGCAAGUACU UUU |
| hsa-miR-548l MIMAT0005889 | 3792 | AAAAGUAUUUGCGGGUU UUGUC | 3793 | AAAAGUAUUUGC GGGUUUUG | 3794 | CCGCAAAUACU UUU |
| hsa-miR-548m MIMAT0005917 | 3795 | CAAAGGUAUUUGUGGUU UUUG | 3796 | CAAAGGUAUUUG UGGUUUUU | 3797 | CACAAAUACCU UUG |
| hsa-miR-548n MIMAT0005916 | 3798 | CAAAAGUAAUUGUGGAU UUUGU | 3799 | CAAAAGUAAUUG UGGAUUUU | 3800 | CACAAUUACUU UUG |
| hsa-miR-548o MIMAT0005919 | 3801 | CCAAAACUGCAGUUACU UUUGC | 3802 | CCAAAACUGCAG UUACUUUU | 3803 | AACUGCAGUUU UGG |
| hsa-miR-548p MIMAT0005934 | 3804 | UAGCAAAAACUGCAGUU ACUUU | 3805 | UAGCAAAAACUG CAGUUACU | 3806 | UGCAGUUUUG CUA |
| hsa-miR-548q MIMAT0011163 | 3807 | GCUGGUGCAAAAGUAAU GGCGG | 3808 | GCUGGUGCAAAA GUAAUGGC | 3809 | ACUUUUGCACC AGC |
| hsa-miR-548s MIMAT0014987 | 3810 | AUGGCCAAAACUGCAGU UAUUUU | 3811 | AUGGCCAAAACU GCAGUUAU | 3812 | GCAGUUUUGGC CAU |
| hsa-miR-548t MIMAT0015009 | 3813 | CAAAAGUGAUCGUGGUU UUUG | 3814 | CAAAAGUGAUCG UGGUUUUU | 3815 | CACGAUCACUU UUG |
| hsa-miR-548u MIMAT0015013 | 3816 | CAAAGACUGCAAUUACU UUUGCG | 3817 | CAAAGACUGCAA UUACUUUU | 3818 | AAUUGCAGUCU UUG |
| hsa-miR-548v MIMAT0015020 | 3819 | AGCUACAGUUACUUUUG CACCA | 3820 | AGCUACAGUUAC UUUUGCAC | 3821 | AAGUAACUGUA GCU |
| hsa-miR-548w MIMAT0015060 | 3822 | AAAAGUAACUGCGGUUU UUGCCU | 3823 | AAAAGUAACUGC GGUUUUUG | 3824 | CCGCAGUUACU UUU |
| hsa-miR-548x MIMAT0015081 | 3825 | UAAAAACUGCAAUUACU UUCA | 3826 | UAAAAACUGCAA UUACUUUC | 3827 | AAUUGCAGUUU UUA |
| hsa-miR-548y MIMAT0018354 | 3828 | AAAAGUAAUCACUGUUU UUGCC | 3829 | AAAAGUAAUCAC UGUUUUUG | 3830 | CAGUGAUUACU UUU |
| hsa-miR-548z MIMAT0018446 | 3831 | CAAAAACCGCAAUUACU UUUGCA | 3832 | CAAAAACCGCAA UUACUUUU | 3833 | AAUUGCGGUUU UUG |
| hsa-miR-549 MIMAT0003333 | 3834 | UGACAACUAUGGAUGAG CUCU | 3835 | UGACAACUAUGG AUGAGCUC | 3836 | AUCCAUAGUUG UCA |
| hsa-miR-550a MIMAT0004800 | 3837 | AGUGCCUGAGGGAGUAA GAGCCC | 3838 | AGUGCCUGAGGG AGUAAGAG | 3839 | CUCCCUCAGGC ACU |
| hsa-miR-550a* MIMAT0003257 | 3840 | UGUCUUACUCCCUCAGG CACAU | 3841 | UGUCUUACUCCC UCAGGCAC | 3842 | GAGGGAGUAAG ACA |
| hsa-miR-550b MIMAT0018445 | 3843 | UCUUACUCCCUCAGGCA CUG | 3844 | UCUUACUCCCUC AGGCACUG | 3845 | CUGAGGGAGUA AGA |
| hsa-miR-551a MIMAT0003214 | 3846 | GCGACCCACUCUUGGUU UCCA | 3847 | GCGACCCACUCU UGGUUUCC | 3848 | CAAGAGUGGGU CGC |
| hsa-miR-551b MIMAT0003233 | 3849 | GCGACCCAUACUUGGUU UCAG | 3850 | GCGACCCAUACU UGGUUUCA | 3851 | CAAGUAUGGGU CGC |
| hsa-miR-551b* MIMAT0004794 | 3852 | GAAAUCAAGCGUGGGUG AGACC | 3853 | GAAAUCAAGCGU GGGUGAGA | 3854 | CCACGCUUGAU UUC |
| hsa-miR-552 MIMAT0003215 | 3855 | AACAGGUGACUGGUUAG ACAA | 3856 | AACAGGUGACUG GUUAGACA | 3857 | ACCAGUCACCU GUU |
| hsa-miR-553 MIMAT0003216 | 3858 | AAAACGGUGAGAUUUUG UUUU | 3859 | AAAACGGUGAGA UUUUGUUU | 3860 | AAUCUCACCGU UUU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-554 MIMAT0003217 | 3861 | GCUAGUCCUGACUCAGC CAGU | 3862 | GCUAGUCCUGAC UCAGCCAG | 3863 | GAGUCAGGACU AGC |
| hsa-miR-555 MIMAT0003219 | 3864 | AGGGUAAGCUGAACCUC UGAU | 3865 | AGGGUAAGCUGA ACCUCUGA | 3866 | GUUCAGCUUAC CCU |
| hsa-miR-556-3p MIMAT0004793 | 3867 | AUAUUACCAUUAGCUCA UCUUU | 3868 | AUAUUACCAUUA GCUCAUCU | 3869 | GCUAAUGGUAA UAU |
| hsa-miR-556-5p MIMAT0003220 | 3870 | GAUGAGCUCAUUGUAAU AUGAG | 3871 | GAUGAGCUCAUU GUAAUAUG | 3872 | ACAAUGAGCUC AUC |
| hsa-miR-557 MIMAT0003221 | 3873 | GUUUGCACGGGUGGGCC UUGUCU | 3874 | GUUUGCACGGGU GGGCCUUG | 3875 | CCACCCGUGCA AAC |
| hsa-miR-558 MIMAT0003222 | 3876 | UGAGCUGCUGUACCAAA AU | 3877 | UGAGCUGCUGUA CCAAAAU | 3878 | GGUACAGCAGC UCA |
| hsa-miR-559 MIMAT0003223 | 3879 | UAAAGUAAAUAUGCACC AAAA | 3880 | UAAAGUAAAUAU GCACCAAA | 3881 | GCAUAUUUACU UUA |
| hsa-miR-561 MIMAT0003225 | 3882 | CAAAGUUUAAGAUCCUU GAAGU | 3883 | CAAAGUUUAAGA UCCUUGAA | 3884 | GAUCUUAAACU UUG |
| hsa-miR-562 MIMAT0003226 | 3885 | AAAGUAGCUGUACCAUU UGC | 3886 | AAAGUAGCUGUA CCAUUUGC | 3887 | GGUACAGCUAC UUU |
| hsa-miR-563 MIMAT0003227 | 3888 | AGGUUGACAUACGUUUC CC | 3889 | AGGUUGACAUAC GUUUCCC | 3890 | ACGUAUGUCAA CCU |
| hsa-miR-564 MIMAT0003228 | 3891 | AGGCACGGUGUCAGCAG GC | 3892 | AGGCACGGUGUC AGCAGGC | 3893 | CUGACACCGUG CCU |
| hsa-miR-566 MIMAT0003230 | 3894 | GGGCGCCUGUGAUCCCA AC | 3895 | GGGCGCCUGUGA UCCCAAC | 3896 | GAUCACAGGCG CCC |
| hsa-miR-567 MIMAT0003231 | 3897 | AGUAUGUUCUUCCAGGA CAGAAC | 3898 | AGUAUGUUCUUC CAGGACAG | 3899 | UGGAAGAACAU ACU |
| hsa-miR-568 MIMAT0003232 | 3900 | AUGUAUAAAUGUAUACA CAC | 3901 | AUGUAUAAAUGU AUACACAC | 3902 | AUACAUUUAUA CAU |
| hsa-miR-569 MIMAT0003234 | 3903 | AGUUAAUGAAUCCUGGA AAGU | 3904 | AGUUAAUGAAUC CUGGAAAG | 3905 | AGGAUUCAUUA ACU |
| hsa-miR-570 MIMAT0003235 | 3906 | CGAAAACAGCAAUUACC UUUGC | 3907 | CGAAAACAGCAA UUACCUUU | 3908 | AAUUGCUGUUU UCG |
| hsa-miR-571 MIMAT0003236 | 3909 | UGAGUUGGCCAUCUGAG UGAG | 3910 | UGAGUUGGCCAU CUGAGUGA | 3911 | AGAUGGCCAAC UCA |
| hsa-miR-572 MIMAT0003237 | 3912 | GUCCGCUCGGCGGUGGC CCA | 3913 | GUCCGCUCGGCG GUGGCCCA | 3914 | ACCGCCGAGCG GAC |
| hsa-miR-573 MIMAT0003238 | 3915 | CUGAAGUGAUGUGUAAC UGAUCAG | 3916 | CUGAAGUGAUGU GUAACUGA | 3917 | ACACAUCACUU CAG |
| hsa-miR-574-3p MIMAT0003239 | 3918 | CACGCUCAUGCACACAC CCACA | 3919 | CACGCUCAUGCA CACACCCA | 3920 | UGUGCAUGAGC GUG |
| hsa-miR-574-5p MIMAT0004795 | 3921 | UGAGUGUGUGUGUGUGA GUGUGU | 3922 | UGAGUGUGUGUG UGUGAGUG | 3923 | CACACACACAC UCA |
| hsa-miR-575 MIMAT0003240 | 3924 | GAGCCAGUUGGACAGGA GC | 3925 | GAGCCAGUUGGA CAGGAGC | 3926 | UGUCCAACUGG CUC |
| hsa-miR-576-3p MIMAT0004796 | 3927 | AAGAUGUGGAAAAAUUG GAAUC | 3928 | AAGAUGUGGAAA AAUUGGAA | 3929 | UUUUUCCACAU CUU |
| hsa-miR-576-5p MIMAT0003241 | 3930 | AUUCUAAUUUCUCCACG UCUUU | 3931 | AUUCUAAUUUCU CCACGUCU | 3932 | GGAGAAAUUAG AAU |
| hsa-miR-577 MIMAT0003242 | 3933 | UAGAUAAAAUAUUGGUA CCUG | 3934 | UAGAUAAAAUAU UGGUACCU | 3935 | CAAUAUUUUAU CUA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-578 MIMAT0003243 | 3936 | CUUCUUGUGCUCUAGGA UUGU | 3937 | CUUCUUGUGCUC UAGGAUUG | 3938 | UAGAGCACAAG AAG |
| hsa-miR-579 MIMAT0003244 | 3939 | UUCAUUUGGUAUAAACC GCGAUU | 3940 | UUCAUUUGGUAU AAACCGCG | 3941 | UUAUACCAAAU GAA |
| hsa-miR-580 MIMAT0003245 | 3942 | UUGAGAAUGAUGAAUCA UUAGG | 3943 | UUGAGAAUGAUG AAUCAUUA | 3944 | UUCAUCAUUCU CAA |
| hsa-miR-581 MIMAT0003246 | 3945 | UCUUGUGUUCUCUAGAU CAGU | 3946 | UCUUGUGUUCUC UAGAUCAG | 3947 | UAGAGAACACA AGA |
| hsa-miR-582-3p MIMAT0004797 | 3948 | UAACUGGUUGAACAACU GAACC | 3949 | UAACUGGUUGAA CAACUGAA | 3950 | UGUUCAACCAG UUA |
| hsa-miR-582-5p MIMAT0003247 | 3951 | UUACAGUUGUUCAACCA GUUACU | 3952 | UUACAGUUGUUC AACCAGUU | 3953 | UUGAACAACUG UAA |
| hsa-miR-583 MIMAT0003248 | 3954 | CAAAGAGGAAGGUCCCA UUAC | 3955 | CAAAGAGGAAGG UCCCAUUA | 3956 | GACCUUCCUCU UUG |
| hsa-miR-584 MIMAT0003249 | 3957 | UUAUGGUUUGCCUGGGA CUGAG | 3958 | UUAUGGUUUGCC UGGGACUG | 3959 | CAGGCAAACCA UAA |
| hsa-miR-585 MIMAT0003250 | 3960 | UGGGCGUAUCUGUAUGC UA | 3961 | UGGGCGUAUCUG UAUGCUA | 3962 | UACAGAUACGC CCA |
| hsa-miR-586 MIMAT0003252 | 3963 | UAUGCAUUGUAUUUUUA GGUCC | 3964 | UAUGCAUUGUAU UUUUAGGU | 3965 | AAAUACAAUGC AUA |
| hsa-miR-587 MIMAT0003253 | 3966 | UUUCCAUAGGUGAUGAG UCAC | 3967 | UUUCCAUAGGUG AUGAGUCA | 3968 | AUCACCUAUGG AAA |
| hsa-miR-588 MIMAT0003255 | 3969 | UUGGCCACAAUGGGUUA GAAC | 3970 | UUGGCCACAAUG GGUUAGAA | 3971 | CCCAUUGUGGC CAA |
| hsa-miR-589 MIMAT0004799 | 3972 | UGAGAACCACGUCUGCU CUGAG | 3973 | UGAGAACCACGU CUGCUCUG | 3974 | AGACGUGGUUC UCA |
| hsa-miR-589* MIMAT0003256 | 3975 | UCAGAACAAAUGCCGGU UCCCAGA | 3976 | UCAGAACAAAUG CCGGUUCC | 3977 | GGCAUUUGUUC UGA |
| hsa-miR-590-3p MIMAT0004801 | 3978 | UAAUUUUAUGUAUAAGC UAGU | 3979 | UAAUUUUAUGUA UAAGCUAG | 3980 | UAUACAUAAAA UUA |
| hsa-miR-590-5p MIMAT0003258 | 3981 | GAGCUUAUUCAUAAAAG UGCAG | 3982 | GAGCUUAUUCAU AAAAGUGC | 3983 | UUAUGAAUAAG CUC |
| hsa-miR-591 MIMAT0003259 | 3984 | AGACCAUGGGUUCUCAU UGU | 3985 | AGACCAUGGGUU CUCAUUGU | 3986 | AGAACCCAUGG UCU |
| hsa-miR-592 MIMAT0003260 | 3987 | UUGUGUCAAUAUGCGAU GAUGU | 3988 | UUGUGUCAAUAU GCGAUGAU | 3989 | GCAUAUUGACA CAA |
| hsa-miR-593 MIMAT0004802 | 3990 | UGUCUCUGCUGGGGUUU CU | 3991 | UGUCUCUGCUGG GGUUUCU | 3992 | CCCCAGCAGAG ACA |
| hsa-miR-593* MIMAT0003261 | 3993 | AGGCACCAGCCAGGCAU UGCUCAGC | 3994 | AGGCACCAGCCA GGCAUUGC | 3995 | CCUGGCUGGUG CCU |
| hsa-miR-595 MIMAT0003263 | 3996 | GAAGUGUGCCGUGGGUGU GUCU | 3997 | GAAGUGUGCCGU GGGUGUGUC | 3998 | CCACGGCACAC UUC |
| hsa-miR-596 MIMAT0003264 | 3999 | AAGCCUGCCCGGCUCCU CGGG | 4000 | AAGCCUGCCCGG CUCCUCGG | 4001 | AGCCGGGCAGG CUU |
| hsa-miR-597 MIMAT0003265 | 4002 | UGUGUCACUCGAUGACC ACUGU | 4003 | UGUGUCACUCGA UGACCACU | 4004 | CAUCGAGUGAC ACA |
| hsa-miR-598 MIMAT0003266 | 4005 | UACGUCAUCGUUGUCAU CGUCA | 4006 | UACGUCAUCGUU GUCAUCGU | 4007 | ACAACGAUGAC GUA |
| hsa-miR-599 MIMAT0003267 | 4008 | GUUGUGUCAGUUUAUCA AAC | 4009 | GUUGUGUCAGUU UAUCAAAC | 4010 | UAAACUGACAC AAC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-600 MIMAT0003268 | 4011 | ACUUACAGACAAGAGCC UUGCUC | 4012 | ACUUACAGACAA GAGCCUUG | 4013 | UCUUGUCUGUA AGU |
| hsa-miR-601 MIMAT0003269 | 4014 | UGGUCUAGGAUUGUUGG AGGAG | 4015 | UGGUCUAGGAUU GUUGGAGG | 4016 | ACAAUCCUAGA CCA |
| hsa-miR-602 MIMAT0003270 | 4017 | GACACGGGCGACAGCUG CGGCCC | 4018 | GACACGGGCGAC AGCUGCGG | 4019 | CUGUCGCCCGU GUC |
| hsa-miR-603 MIMAT0003271 | 4020 | CACACACUGCAAUUACU UUUGC | 4021 | CACACACUGCAA UUACUUUU | 4022 | AAUUGCAGUGU GUG |
| hsa-miR-604 MIMAT0003272 | 4023 | AGGCUGCGGAAUUCAGG AC | 4024 | AGGCUGCGGAAU UCAGGAC | 4025 | GAAUUCCGCAG CCU |
| hsa-miR-605 MIMAT0003273 | 4026 | UAAAUCCCAUGGUGCCU UCUCCU | 4027 | UAAAUCCCAUGG UGCCUUCU | 4028 | CACCAUGGGAU UUA |
| hsa-miR-606 MIMAT0003274 | 4029 | AAACUACUGAAAAUCAA AGAU | 4030 | AAACUACUGAAA AUCAAAGA | 4031 | AUUUUCAGUAG UUU |
| hsa-miR-607 MIMAT0003275 | 4032 | GUUCAAAUCCAGAUCUA UAAC | 4033 | GUUCAAAUCCAG AUCUAUAA | 4034 | AUCUGGAUUUG AAC |
| hsa-miR-608 MIMAT0003276 | 4035 | AGGGGUGGUGUUGGGAC AGCUCCGU | 4036 | AGGGGUGGUGUU GGGACAGC | 4037 | CCAACACCACC CCU |
| hsa-miR-609 MIMAT0003277 | 4038 | AGGGUGUUUCUCUCAUC UCU | 4039 | AGGGUGUUUCUC UCAUCUCU | 4040 | GAGAGAAACAC CCU |
| hsa-miR-610 MIMAT0003278 | 4041 | UGAGCUAAAUGUGUGCU GGGA | 4042 | UGAGCUAAAUGU GUGCUGGG | 4043 | ACACAUUUAGC UCA |
| hsa-miR-611 MIMAT0003279 | 4044 | GCGAGGACCCCUCGGGG UCUGAC | 4045 | GCGAGGACCCCU CGGGGUCU | 4046 | CGAGGGGUCCU CGC |
| hsa-miR-612 MIMAT0003280 | 4047 | GCUGGGCAGGGCUUCUG AGCUCCUU | 4048 | GCUGGGCAGGGC UUCUGAGC | 4049 | AAGCCCUGCCC AGC |
| hsa-miR-613 MIMAT0003281 | 4050 | AGGAAUGUUCCUUCUUU GCC | 4051 | AGGAAUGUUCCU UCUUUGCC | 4052 | GAAGGAACAUU CCU |
| hsa-miR-614 MIMAT0003282 | 4053 | GAACGCCUGUUCUUGCC AGGUGG | 4054 | GAACGCCUGUUC UUGCCAGG | 4055 | AAGAACAGGCG UUC |
| hsa-miR-615-3p MIMAT0003283 | 4056 | UCCGAGCCUGGGUCUCC CUCUU | 4057 | UCCGAGCCUGGG UCUCCCUC | 4058 | GACCCAGGCUC GGA |
| hsa-miR-615-5p MIMAT0004804 | 4059 | GGGGGUCCCCGGUGCUC GGAUC | 4060 | GGGGGUCCCCGG UGCUCGGA | 4061 | CACCGGGGACC CCC |
| hsa-miR-616 MIMAT0004805 | 4062 | AGUCAUUGGAGGGUUUG AGCAG | 4063 | AGUCAUUGGAGG GUUUGAGC | 4064 | ACCCUCCAAUG ACU |
| hsa-miR-616* MIMAT0003284 | 4065 | ACUCAAAACCCUUCAGU GACUU | 4066 | ACUCAAAACCCU UCAGUGAC | 4067 | GAAGGGUUUUG AGU |
| hsa-miR-617 MIMAT0003286 | 4068 | AGACUUCCCAUUUGAAG GUGGC | 4069 | AGACUUCCCAUU UGAAGGUG | 4070 | CAAAUGGGAAG UCU |
| hsa-miR-618 MIMAT0003287 | 4071 | AAACUCUACUUGUCCUU CUGAGU | 4072 | AAACUCUACUUG UCCUUCUG | 4073 | GACAAGUAGAG UUU |
| hsa-miR-619 MIMAT0003288 | 4074 | GACCUGGACAUGUUUGU GCCCAGU | 4075 | GACCUGGACAUG UUUGUGCC | 4076 | AACAUGUCCAG GUC |
| hsa-miR-620 MIMAT0003289 | 4077 | AUGGAGAUAGAUAUAGA AAU | 4078 | AUGGAGAUAGAU AUAGAAAU | 4079 | AUAUCUAUCUC CAU |
| hsa-miR-621 MIMAT0003290 | 4080 | GGCUAGCAACAGCGCUU ACCU | 4081 | GGCUAGCAACAG CGCUUACC | 4082 | CGCUGUUGCUA GCC |
| hsa-miR-622 MIMAT0003291 | 4083 | ACAGUCUGCUGAGGUUG GAGC | 4084 | ACAGUCUGCUGA GGUUGGAG | 4085 | CCUCAGCAGAC UGU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-623 MIMAT0003292 | 4086 | AUCCCUUGCAGGGGCUG UUGGGU | 4087 | AUCCCUUGCAGG GGCUGUUG | 4088 | CCCCUGCAAGG GAU |
| hsa-miR-624 MIMAT0004807 | 4089 | CACAAGGUAUUGGUAUU ACCU | 4090 | CACAAGGUAUUG GUAUUACC | 4091 | ACCAAUACCUU GUG |
| hsa-miR-624* MIMAT0003293 | 4092 | UAGUACCAGUACCUUGU GUUCA | 4093 | UAGUACCAGUAC CUUGUGUU | 4094 | AGGUACUGGUA CUA |
| hsa-miR-625 MIMAT0003294 | 4095 | AGGGGGAAAGUUCUAUA GUCC | 4096 | AGGGGGAAAGUU CUAUAGUC | 4097 | AGAACUUUCCC CCU |
| hsa-miR-625* MIMAT0004808 | 4098 | GACUAUAGAACUUUCCC CCUCA | 4099 | GACUAUAGAACU UUCCCCCU | 4100 | AAAGUUCUAUA GUC |
| hsa-miR-626 MIMAT0003295 | 4101 | AGCUGUCUGAAAAUGUC UU | 4102 | AGCUGUCUGAAA AUGUCUU | 4103 | AUUUUCAGACA GCU |
| hsa-miR-627 MIMAT0003296 | 4104 | GUGAGUCUCUAAGAAAA GAGGA | 4105 | GUGAGUCUCUAA GAAAAGAG | 4106 | UCUUAGAGACU CAC |
| hsa-miR-628-3p MIMAT0003297 | 4107 | UCUAGUAAGAGUGGCAG UCGA | 4108 | UCUAGUAAGAGU GGCAGUCG | 4109 | CCACUCUUACU AGA |
| hsa-miR-628-5p MIMAT0004809 | 4110 | AUGCUGACAUAUUUACU AGAGG | 4111 | AUGCUGACAUAU UUACUAGA | 4112 | AAAUAUGUCAG CAU |
| hsa-miR-629 MIMAT0004810 | 4113 | UGGGUUUACGUUGGGAG AACU | 4114 | UGGGUUUACGUU GGGAGAAC | 4115 | CCAACGUAAAC CCA |
| hsa-miR-629* MIMAT0003298 | 4116 | GUUCUCCCAACGUAAGC CCAGC | 4117 | GUUCUCCCAACG UAAGCCCA | 4118 | UACGUUGGGAG AAC |
| hsa-miR-630 MIMAT0003299 | 4119 | AGUAUUCUGUACCAGGG AAGGU | 4120 | AGUAUUCUGUAC CAGGGAAG | 4121 | UGGUACAGAAU ACU |
| hsa-miR-631 MIMAT0003300 | 4122 | AGACCUGGCCCAGACCU CAGC | 4123 | AGACCUGGCCCA GACCUCAG | 4124 | UCUGGGCCAGG UCU |
| hsa-miR-632 MIMAT0003302 | 4125 | GUGUCUGCUUCCUGUGG GA | 4126 | GUGUCUGCUUCC UGUGGGA | 4127 | CAGGAAGCAGA CAC |
| hsa-miR-633 MIMAT0003303 | 4128 | CUAAUAGUAUCUACCAC AAUAAA | 4129 | CUAAUAGUAUCU ACCACAAU | 4130 | GUAGAUACUAU UAG |
| hsa-miR-634 MIMAT0003304 | 4131 | AACCAGCACCCCAACUU UGGAC | 4132 | AACCAGCACCCC AACUUUGG | 4133 | UUGGGGUGCUG GUU |
| hsa-miR-635 MIMAT0003305 | 4134 | ACUUGGGCACUGAAACA AUGUCC | 4135 | ACUUGGGCACUG AAACAAUG | 4136 | UUCAGUGCCCA AGU |
| hsa-miR-636 MIMAT0003306 | 4137 | UGUGCUUGCUCGUCCCG CCCGCA | 4138 | UGUGCUUGCUCG UCCCGCCC | 4139 | GACGAGCAAGC ACA |
| hsa-miR-637 MIMAT0003307 | 4140 | ACUGGGGGCUUUCGGGC UCUGCGU | 4141 | ACUGGGGGCUUU CGGGCUCU | 4142 | CGAAAGCCCCC AGU |
| hsa-miR-638 MIMAT0003308 | 4143 | AGGGAUCGCGGGCGGGU GGCGGCCU | 4144 | AGGGAUCGCGGG CGGGUGGC | 4145 | CGCCCGCGAUC CCU |
| hsa-miR-639 MIMAT0003309 | 4146 | AUCGCUGCGGUUGCGAG CGCUGU | 4147 | AUCGCUGCGGUU GCGAGCGC | 4148 | GCAACCGCAGC GAU |
| hsa-miR-640 MIMAT0003310 | 4149 | AUGAUCCAGGAACCUGC CUCU | 4150 | AUGAUCCAGGAA CCUGCCUC | 4151 | GGUUCCUGGAU CAU |
| hsa-miR-641 MIMAT0003311 | 4152 | AAAGACAUAGGAUAGAG UCACCUC | 4153 | AAAGACAUAGGA UAGAGUCA | 4154 | UAUCCUAUGUC UUU |
| hsa-miR-642a MIMAT0003312 | 4155 | GUCCCUCUCCAAAUGUG UCUUG | 4156 | GUCCCUCUCCAA AUGUGUCU | 4157 | AUUUGGAGAGG GAC |
| hsa-miR-642b MIMAT0018444 | 4158 | AGACACAUUUGGAGAGG GACCC | 4159 | AGACACAUUUGG AGAGGGAC | 4160 | CUCCAAAUGUG UCU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-643 MIMAT0003313 | 4161 | ACUUGUAUGCUAGCUCA GGUAG | 4162 | ACUUGUAUGCUA GCUCAGGU | 4163 | GCUAGCAUACA AGU |
| hsa-miR-644 MIMAT0003314 | 4164 | AGUGUGGCUUUCUUAGA GC | 4165 | AGUGUGGCUUUC UUAGAGC | 4166 | AAGAAAGCCAC ACU |
| hsa-miR-645 MIMAT0003315 | 4167 | UCUAGGCUGGUACUGCU GA | 4168 | UCUAGGCUGGUA CUGCUGA | 4169 | AGUACCAGCCU AGA |
| hsa-miR-646 MIMAT0003316 | 4170 | AAGCAGCUGCCUCUGAG GC | 4171 | AAGCAGCUGCCU CUGAGGC | 4172 | AGAGGCAGCUG CUU |
| hsa-miR-647 MIMAT0003317 | 4173 | GUGGCUGCACUCACUUC CUUC | 4174 | GUGGCUGCACUC ACUUCCUU | 4175 | GUGAGUGCAGC CAC |
| hsa-miR-648 MIMAT0003318 | 4176 | AAGUGUGCAGGGCACUG GU | 4177 | AAGUGUGCAGGG CACUGGU | 4178 | UGCCCUGCACA CUU |
| hsa-miR-649 MIMAT0003319 | 4179 | AAACCUGUGUUGUUCAA GAGUC | 4180 | AAACCUGUGUUG UUCAAGAG | 4181 | AACAACACAGG UUU |
| hsa-miR-650 MIMAT0003320 | 4182 | AGGAGGCAGCGCUCUCA GGAC | 4183 | AGGAGGCAGCGC UCUCAGGA | 4184 | GAGCGCUGCCU CCU |
| hsa-miR-651 MIMAT0003321 | 4185 | UUUAGGAUAAGCUUGAC UUUUG | 4186 | UUUAGGAUAAGC UUGACUUU | 4187 | AAGCUUAUCCU AAA |
| hsa-miR-652 MIMAT0003322 | 4188 | AAUGGCGCCACUAGGGU UGUG | 4189 | AAUGGCGCCACU AGGGUUGU | 4190 | CUAGUGGCGCC AUU |
| hsa-miR-653 MIMAT0003328 | 4191 | GUGUUGAAACAAUCUCU ACUG | 4192 | GUGUUGAAACAA UCUCUACU | 4193 | GAUUGUUUCAA CAC |
| hsa-miR-654-3p MIMAT0004814 | 4194 | UAUGUCUGCUGACCAUC ACCUU | 4195 | UAUGUCUGCUGA CCAUCACC | 4196 | GGUCAGCAGAC AUA |
| hsa-miR-654-5p MIMAT0003330 | 4197 | UGGUGGGCCGCAGAACA UGUGC | 4198 | UGGUGGGCCGCA GAACAUGU | 4199 | UCUGCGGCCCA CCA |
| hsa-miR-655 MIMAT0003331 | 4200 | AUAAUACAUGGUUAACC UCUUU | 4201 | AUAAUACAUGGU UAACCUCU | 4202 | UAACCAUGUAU UAU |
| hsa-miR-656 MIMAT0003332 | 4203 | AAUAUUAUACAGUCAAC CUCU | 4204 | AAUAUUAUACAG UCAACCUC | 4205 | GACUGUAUAAU AUU |
| hsa-miR-657 MIMAT0003335 | 4206 | GGCAGGUUCUCACCCUC UCUAGG | 4207 | GGCAGGUUCUCA CCCUCUCU | 4208 | GGUGAGAACCU GCC |
| hsa-miR-658 MIMAT0003336 | 4209 | GGCGGAGGGAAGUAGGU CCGUUGGU | 4210 | GGCGGAGGGAAG UAGGUCCG | 4211 | UACUUCCCUCC GCC |
| hsa-miR-659 MIMAT0003337 | 4212 | CUUGGUUCAGGGAGGGU CCCCA | 4213 | CUUGGUUCAGGG AGGGUCCC | 4214 | CUCCCUGAACC AAG |
| hsa-miR-660 MIMAT0003338 | 4215 | UACCCAUUGCAUAUCGG AGUUG | 4216 | UACCCAUUGCAU AUCGGAGU | 4217 | AUAUGCAAUGG GUA |
| hsa-miR-661 MIMAT0003324 | 4218 | UGCCUGGGUCUCUGGCC UGCGCGU | 4219 | UGCCUGGGUCUC UGGCCUGC | 4220 | CAGAGACCCAG GCA |
| hsa-miR-662 MIMAT0003325 | 4221 | UCCCACGUUGUGGCCCA GCAG | 4222 | UCCCACGUUGUG GCCCAGCA | 4223 | GCCACAACGUG GGA |
| hsa-miR-663 MIMAT0003326 | 4224 | AGGCGGGGCGCCGCGGG ACCGC | 4225 | AGGCGGGGCGCC GCGGGACC | 4226 | GCGGCGCCCCG CCU |
| hsa-miR-663b MIMAT0005867 | 4227 | GGUGGCCCGGCCGUGCC UGAGG | 4228 | GGUGGCCCGGCC GUGCCUGA | 4229 | ACGGCCGGGCC ACC |
| hsa-miR-664 MIMAT0005949 | 4230 | UAUUCAUUUAUCCCCAG CCUACA | 4231 | UAUUCAUUUAUC CCCAGCCU | 4232 | GGGAUAAAUGA AUA |
| hsa-miR-664* MIMAT0005948 | 4233 | ACUGGCUAGGGAAAAUG AUUGGAU | 4234 | ACUGGCUAGGGA AAAUGAUU | 4235 | UUUCCCUAGCC AGU |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-665 MIMAT0004952 | 4236 | ACCAGGAGGCUGAGGCC CCU | 4237 | ACCAGGAGGCUG AGGCCCCU | 4238 | CUCAGCCUCCU GGU |
| hsa-miR-668 MIMAT0003881 | 4239 | UGUCACUCGGCUCGGCC CACUAC | 4240 | UGUCACUCGGCU CGGCCCAC | 4241 | CGAGCCGAGUG ACA |
| hsa-miR-670 MIMAT0010357 | 4242 | GUCCCUGAGUGUAUGUG GUG | 4243 | GUCCCUGAGUGU AUGUGGUG | 4244 | AUACACUCAGG GAC |
| hsa-miR-671-3p MIMAT0004819 | 4245 | UCCGGUUCUCAGGGCUC CACC | 4246 | UCCGGUUCUCAG GGCUCCAC | 4247 | CCCUGAGAACC GGA |
| hsa-miR-671-5p MIMAT0003880 | 4248 | AGGAAGCCCUGGAGGGG CUGGAG | 4249 | AGGAAGCCCUGG AGGGGCUG | 4250 | CUCCAGGGCUU CCU |
| hsa-miR-675 MIMAT0004284 | 4251 | UGGUGCGGAGAGGGCCC ACAGUG | 4252 | UGGUGCGGAGAG GGCCCACA | 4253 | CCCUCUCCGCA CCA |
| hsa-miR-675* MIMAT0006790 | 4254 | CUGUAUGCCCUCACCGC UCA | 4255 | CUGUAUGCCCUC ACCGCUCA | 4256 | GUGAGGGCAUA CAG |
| hsa-miR-676 MIMAT0018204 | 4257 | CUGUCCUAAGGUUGUUG AGUU | 4258 | CUGUCCUAAGGU UGUUGAGU | 4259 | CAACCUUAGGA CAG |
| hsa-miR-676* MIMAT0018203 | 4260 | UCUUCAACCUCAGGACU UGCA | 4261 | UCUUCAACCUCA GGACUUGC | 4262 | CCUGAGGUUGA AGA |
| hsa-miR-7 MIMAT0000252 | 4263 | UGGAAGACUAGUGAUUU UGUUGU | 4264 | UGGAAGACUAGU GAUUUUGU | 4265 | UCACUAGUCUU CCA |
| hsa-miR-708 MIMAT0004926 | 4266 | AAGGAGCUUACAAUCUA GCUGGG | 4267 | AAGGAGCUUACA AUCUAGCU | 4268 | AUUGUAAGCUC CUU |
| hsa-miR-708* MIMAT0004927 | 4269 | CAACUAGACUGUGAGCU UCUAG | 4270 | CAACUAGACUGU GAGCUUCU | 4271 | UCACAGUCUAG UUG |
| hsa-miR-7-1* MIMAT0004553 | 4272 | CAACAAAUCACAGUCUG CCAUA | 4273 | CAACAAAUCACA GUCUGCCA | 4274 | ACUGUGAUUUG UUG |
| hsa-miR-711 MIMAT0012734 | 4275 | GGGACCCAGGGAGAGAC GUAAG | 4276 | GGGACCCAGGGA GAGACGUA | 4277 | UCUCCCUGGGU CCC |
| hsa-miR-718 MIMAT0012735 | 4278 | CUUCCGCCCCGCCGGGC GUCG | 4279 | CUUCCGCCCCGC CGGGCGUC | 4280 | CGGCGGGGCGG AAG |
| hsa-miR-7-2* MIMAT0004554 | 4281 | CAACAAAUCCCAGUCUA CCUAA | 4282 | CAACAAAUCCCA GUCUACCU | 4283 | ACUGGAUUUG UUG |
| hsa-miR-720 MIMAT0005954 | 4284 | UCUCGCUGGGGCCUCCA | 4285 | UCUCGCUGGGGC CUCCA | 4286 | AGGCCCCAGCG AGA |
| hsa-miR-744 MIMAT0004945 | 4287 | UGCGGGGCUAGGGCUAA CAGCA | 4288 | UGCGGGGCUAGG GCUAACAG | 4289 | GCCCUAGCCCC GCA |
| hsa-miR-744* MIMAT0004946 | 4290 | CUGUUGCCACUAACCUC AACCU | 4291 | CUGUUGCCACUA ACCUCAAC | 4292 | GUUAGUGGCAA CAG |
| hsa-miR-758 MIMAT0003879 | 4293 | UUUGUGACCUGGUCCAC UAACC | 4294 | UUUGUGACCUGG UCCACUAA | 4295 | GACCAGGUCAC AAA |
| hsa-miR-759 MIMAT0010497 | 4296 | GCAGAGUGCAAACAAUU UUGAC | 4297 | GCAGAGUGCAAA CAAUUUUG | 4298 | UGUUUGCACUC UGC |
| hsa-miR-760 MIMAT0004957 | 4299 | CGGCUCUGGGUCUGUGG GGA | 4300 | CGGCUCUGGGUC UGUGGGGA | 4301 | CAGACCCAGAG CCG |
| hsa-miR-761 MIMAT0010364 | 4302 | GCAGCAGGGUGAAACUG ACACA | 4303 | GCAGCAGGGUGA AACUGACA | 4304 | UUUCACCCUGC UGC |
| hsa-miR-762 MIMAT0010313 | 4305 | GGGGCUGGGGCCGGGGC CGAGC | 4306 | GGGGCUGGGGCC GGGGCCGA | 4307 | CCGGCCCCAGC CCC |
| hsa-miR-764 MIMAT0010367 | 4308 | GCAGGUGCUCACUUGUC CUCCU | 4309 | GCAGGUGCUCAC UUGUCCUC | 4310 | AAGUGAGCACC UGC |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-765 MIMAT0003945 | 4311 | UGGAGGAGAAGGAAGGUGAUG | 4312 | UGGAGGAGAAGGAAGGUGAU | 4313 | UUCCUUCUCCUCCA |
| hsa-miR-766 MIMAT0003888 | 4314 | ACUCCAGCCCCACAGCCUCAGC | 4315 | ACUCCAGCCCCACAGCCUCA | 4316 | UGUGGGGCUGGAGU |
| hsa-miR-767-3p MIMAT0003883 | 4317 | UCUGCUCAUACCCCAUGGUUUCU | 4318 | UCUGCUCAUACCCCAUGGUU | 4319 | GGGGUAUGAGCAGA |
| hsa-miR-767-5p MIMAT0003882 | 4320 | UGCACCAUGGUUGUCUGAGCAUG | 4321 | UGCACCAUGGUUGUCUGAGC | 4322 | ACAACCAUGGUGCA |
| hsa-miR-769-3p MIMAT0003887 | 4323 | CUGGGAUCUCCGGGGUCUUGGUU | 4324 | CUGGGAUCUCCGGGGUCUUG | 4325 | CCCGGAGAUCCCAG |
| hsa-miR-769-5p MIMAT0003886 | 4326 | UGAGACCUCUGGGUUCUGAGCU | 4327 | UGAGACCUCUGGGUUCUGAG | 4328 | ACCCAGAGGUCUCA |
| hsa-miR-770-5p MIMAT0003948 | 4329 | UCCAGUACCACGUGUCAGGGCCA | 4330 | UCCAGUACCACGUGUCAGGG | 4331 | CACGUGGUACUGGA |
| hsa-miR-802 MIMAT0004185 | 4332 | CAGUAACAAAGAUUCAUCCUUGU | 4333 | CAGUAACAAAGAUUCAUCCU | 4334 | AAUCUUUGUUACUG |
| hsa-miR-873 MIMAT0004953 | 4335 | GCAGGAACUUGUGAGUCUCCU | 4336 | GCAGGAACUUGUGAGUCUCC | 4337 | UCACAAGUUCCUGC |
| hsa-miR-874 MIMAT0004911 | 4338 | CUGCCCUGGCCCGAGGGACCGA | 4339 | CUGCCCUGGCCCGAGGGACC | 4340 | UCGGGCCAGGGCAG |
| hsa-miR-875-3p MIMAT0004923 | 4341 | CCUGGAAACACUGAGGUUGUG | 4342 | CCUGGAAACACUGAGGUUGU | 4343 | UCAGUGUUUCCAGG |
| hsa-miR-875-5p MIMAT0004922 | 4344 | UAUACCCUCAGUUUUAUCAGGUG | 4345 | UAUACCCUCAGUUUUAUCAGG | 4346 | AAAACUGAGGUAUA |
| hsa-miR-876-3p MIMAT0004925 | 4347 | UGGUGGUUUACAAAGUAAUUCA | 4348 | UGGUGGUUUACAAAGUAAUU | 4349 | UUUGUAAACCACCA |
| hsa-miR-876-5p MIMAT0004924 | 4350 | UGGAUUUCUUUGUGAAUCACCA | 4351 | UGGAUUUCUUUGUGAAUCAC | 4352 | CACAAAGAAAUCCA |
| hsa-miR-877 MIMAT0004949 | 4353 | GUAGAGGAGAUGGCGCAGGG | 4354 | GUAGAGGAGAUGGCGCAGGG | 4355 | GCCAUCUCCUCUAC |
| hsa-miR-877* MIMAT0004950 | 4356 | UCCUCUUCUCCCUCCUCCAG | 4357 | UCCUCUUCUCCCUCCUCCCA | 4358 | GAGGGAGAAGAGGA |
| hsa-miR-885-3p MIMAT0004948 | 4359 | AGGCAGCGGGGUGUAGUGGAUA | 4360 | AGGCAGCGGGGUGUAGUGGA | 4361 | ACACCCCGCUGCCU |
| hsa-miR-885-5p MIMAT0004947 | 4362 | UCCAUUACACUACCCUGCCUCU | 4363 | UCCAUUACACUACCCUGCCU | 4364 | GGUAGUGUAAUGGA |
| hsa-miR-887 MIMAT0004951 | 4365 | GUGAACGGGCGCCAUCCCGAGG | 4366 | GUGAACGGGCGCCAUCCCGA | 4367 | UGGCGCCCGUUCAC |
| hsa-miR-888 MIMAT0004916 | 4368 | UACUCAAAAAGCUGUCAGUCA | 4369 | UACUCAAAAAGCUGUCAGUC | 4370 | CAGCUUUUUGAGUA |
| hsa-miR-888* MIMAT0004917 | 4371 | GACUGACACCUCUUUGGUGAA | 4372 | GACUGACACCUCUUUGGGUG | 4373 | AAGAGGUGUCAGUC |
| hsa-miR-889 MIMAT0004921 | 4374 | UUAAUAUCGGACAACCAUUGU | 4375 | UUAAUAUCGGACAACCAUUG | 4376 | UUGUCCGAUAUUAA |
| hsa-miR-890 MIMAT0004912 | 4377 | UACUUGGAAAGGCAUCAGUUG | 4378 | UACUUGGAAAGGCAUCAGUU | 4379 | UGCCUUUCCAAGUA |
| hsa-miR-891a MIMAT0004902 | 4380 | UGCAACGAACCUGAGCCACUGA | 4381 | UGCAACGAACCUGAGCCACU | 4382 | UCAGGUUCGUUGCA |
| hsa-miR-891b MIMAT0004913 | 4383 | UGCAACUUACCUGAGUCAUUGA | 4384 | UGCAACUUACCUGAGUCAUU | 4385 | UCAGGUAAGUUGCA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-892a MIMAT0004907 | 4386 | CACUGUGUCCUUUCUGC GUAG | 4387 | CACUGUGUCCUU UCUGCGUA | 4388 | GAAAGGACACA GUG |
| hsa-miR-892b MIMAT0004918 | 4389 | CACUGGCUCCUUUCUGG GUAGA | 4390 | CACUGGCUCCUU UCUGGGUA | 4391 | GAAAGGAGCCA GUG |
| hsa-miR-9 MIMAT0000441 | 4392 | UCUUUGGUUAUCUAGCU GUAUGA | 4393 | UCUUUGGUUAUC UAGCUGUA | 4394 | UAGAUAACCAA AGA |
| hsa-miR-9* MIMAT0000442 | 4395 | AUAAAGCUAGAUAACCG AAAGU | 4396 | AUAAAGCUAGAU AACCGAAA | 4397 | UUAUCUAGCUU UAU |
| hsa-miR-920 MIMAT0004970 | 4398 | GGGGAGCUGUGGAAGCA GUA | 4399 | GGGGAGCUGUGG AAGCAGUA | 4400 | UUCCACAGCUC CCC |
| hsa-miR-921 MIMAT0004971 | 4401 | CUAGUGAGGGACAGAAC CAGGAUUC | 4402 | CUAGUGAGGGAC AGAACCAG | 4403 | CUGUCCCUCAC UAG |
| hsa-miR-922 MIMAT0004972 | 4404 | GCAGCAGAGAAUAGGAC UACGUC | 4405 | GCAGCAGAGAAU AGGACUAC | 4406 | CUAUUCUCUGC UGC |
| hsa-miR-924 MIMAT0004974 | 4407 | AGAGUCUUGUGAUGUCU UGC | 4408 | AGAGUCUUGUGA UGUCUUGC | 4409 | CAUCACAAGAC UCU |
| hsa-miR-92a MIMAT0000092 | 4410 | UAUUGCACUUGUCCCGG CCUGU | 4411 | UAUUGCACUUGU CCCGGCCU | 4412 | GGACAAGUGCA AUA |
| hsa-miR-92a-1* MIMAT0004507 | 4413 | AGGUUGGGAUCGGUUGC AAUGCU | 4414 | AGGUUGGGAUCG GUUGCAAU | 4415 | ACCGAUCCCAA CCU |
| hsa-miR-92a-2* MIMAT0004508 | 4416 | GGGUGGGGAUUUGUUGC AUUAC | 4417 | GGGUGGGGAUUU GUUGCAUU | 4418 | ACAAAUCCCCA CCC |
| hsa-miR-92b MIMAT0003218 | 4419 | UAUUGCACUCGUCCCGG CCUCC | 4420 | UAUUGCACUCGU CCCGGCCU | 4421 | GGACGAGUGCA AUA |
| hsa-miR-92b* MIMAT0004792 | 4422 | AGGGACGGGACGCGGUG CAGUG | 4423 | AGGGACGGGACG CGGUGCAG | 4424 | CGCGUCCCGUC CCU |
| hsa-miR-93 MIMAT0000093 | 4425 | CAAAGUGCUGUUCGUGC AGGUAG | 4426 | CAAAGUGCUGUU CGUGCAGG | 4427 | CGAACAGCACU UUG |
| hsa-miR-93* MIMAT0004509 | 4428 | ACUGCUGAGCUAGCACU UCCCG | 4429 | ACUGCUGAGCUA GCACUUCC | 4430 | GCUAGCUCAGC AGU |
| hsa-miR-933 MIMAT0004976 | 4431 | UGUGCGCAGGGAGACCU CUCCC | 4432 | UGUGCGCAGGGA GACCUCUC | 4433 | UCUCCCUGCGC ACA |
| hsa-miR-934 MIMAT0004977 | 4434 | UGUCUACUACUGGAGAC ACUGG | 4435 | UGUCUACUACUG GAGACACU | 4436 | UCCAGUAGUAG ACA |
| hsa-miR-935 MIMAT0004978 | 4437 | CCAGUUACCGCUUCCGC UACCGC | 4438 | CCAGUUACCGCU UCCGCUAC | 4439 | GAAGCGGUAAC UGG |
| hsa-miR-936 MIMAT0004979 | 4440 | ACAGUAGAGGGAGGAAU CGCAG | 4441 | ACAGUAGAGGGA GGAAUCGC | 4442 | CCUCCCUCUAC UGU |
| hsa-miR-937 MIMAT0004980 | 4443 | AUCCGCGCUCUGACUCU CUGCC | 4444 | AUCCGCGCUCUG ACUCUCUG | 4445 | GUCAGAGCGCG GAU |
| hsa-miR-938 MIMAT0004981 | 4446 | UGCCCUUAAAGGUGAAC CCAGU | 4447 | UGCCCUUAAAGG UGAACCCA | 4448 | CACCUUUAAGG GCA |
| hsa-miR-939 MIMAT0004982 | 4449 | UGGGGAGCUGAGGCUCU GGGGGUG | 4450 | UGGGGAGCUGAG GCUCUGGG | 4451 | GCCUCAGCUCC CCA |
| hsa-miR-940 MIMAT0004983 | 4452 | AAGGCAGGGCCCCCGCU CCCC | 4453 | AAGGCAGGGCCC CCGCUCCC | 4454 | GGGGGCCCUGC CUU |
| hsa-miR-941 MIMAT0004984 | 4455 | CACCCGGCUGUGUGCAC AUGUGC | 4456 | CACCCGGCUGUG UGCACAUG | 4457 | CACACAGCCGG GUG |
| hsa-miR-942 MIMAT0004985 | 4458 | UCUUCUCUGUUUUGGCC AUGUG | 4459 | UCUUCUCUGUUU UGGCCAUG | 4460 | CAAAACAGAGA AGA |

TABLE 4-continued sd-rxRNA miRNA designs

| miRNA Name | SEQ ID NO | miRNA Sequence mature | SEQ ID NO | sd-rxRNA Antisense | SEQ ID NO | sd-rxRNA Sense |
|---|---|---|---|---|---|---|
| hsa-miR-943 MIMAT0004986 | 4461 | CUGACUGUUGCCGUCCU CCAG | 4462 | CUGACUGUUGCC GUCCUCCA | 4463 | ACGGCAACAGU CAG |
| hsa-miR-944 MIMAT0004987 | 4464 | AAAUUAUUGUACAUCGG AUGAG | 4465 | AAAUUAUUGUAC AUCGGAUG | 4466 | AUGUACAAUAA UUU |
| hsa-miR-95 MIMAT0000094 | 4467 | UUCAACGGGUAUUUAUU GAGCA | 4468 | UUCAACGGGUAU UUAUUGAG | 4469 | AAAUACCCGUU GAA |
| hsa-miR-96 MIMAT0000095 | 4470 | UUUGGCACUAGCACAUU UUUGCU | 4471 | UUUGGCACUAGC ACAUUUUU | 4472 | GUGCUAGUGCC AAA |
| hsa-miR-96* MIMAT0004510 | 4473 | AAUCAUGUGCAGUGCCA AUAUG | 4474 | AAUCAUGUGCAG UGCCAAUA | 4475 | CACUGCACAUG AUU |
| hsa-miR-98 MIMAT0000096 | 4476 | UGAGGUAGUAAGUUGUA UUGUU | 4477 | UGAGGUAGUAAG UUGUAUUG | 4478 | AACUUACUACC UCA |
| hsa-miR-99a MIMAT0000097 | 4479 | AACCCGUAGAUCCGAUC UUGUG | 4480 | AACCCGUAGAUC CGAUCUUG | 4481 | CGGAUCUACGG GUU |
| hsa-miR-99a* MIMAT0004511 | 4482 | CAAGCUCGCUUCUAUGG GUCUG | 4483 | CAAGCUCGCUUC UAUGGGUC | 4484 | UAGAAGCGAGC UUG |
| hsa-miR-99b MIMAT0000689 | 4485 | CACCCGUAGAACCGACC UUGCG | 4486 | CACCCGUAGAAC CGACCUUG | 4487 | CGGUUCUACGG GUG |
| hsa-miR-99b* MIMAT0004678 | 4488 | CAAGCUCGUGUCUGUGG GUCCG | 4489 | CAAGCUCGUGUC UGUGGGUC | 4490 | CAGACACGAGC UUG |

TABLE 5

Examples of chemical modification patterns

| miRNA Name | Example of modified AS strand | Example of modified sense strand |
|---|---|---|
| hsa-let-7a MIMAT0000062 | 5'Pm0005f0f05f05f05f00f05f005f05f05m0*5m* 0*5m0*f0*5m0*0 | m0m00m0m00m0m000m00m0*m0*m0TEGChol |
| hsa-let-7a* MIMAT0004481 | 5'Pm0005f0f05f05f005f0005f00*5m0*0*5 m0*5m0*0*0 | m0m0m0m00m00m00m00m0*m0*m0TEGChol |
| hsa-let-7a-2* MIMAT0010195 | 5'Pm05f05f05f05f005f05f05f00005f00*5m0* 5m0*0*** | m0m0m0m0m0m0m000m00m000*0*m0TEGChol |
| hsa-let-7b MIMAT0000063 | 5'Pm0000f0000f005f05f05f05m0*0*5m0*0*f 0*5m0*0 | m0m000m0m0m0m0m0m0m0m0*m0*m0TEGChol |
| hsa-let-7b* MIMAT0004482 | 5'Pm0005f0f0000f05f05f00*0*5m0*5m0*f 0*0*0 | m0m00m0m00m00m00m00m00m0*m0*m0TEGChol |
| hsa-let-7c MIMAT0000064 | 5'Pm005f05f0f05f000f005f05f05f05m0*5m0* 5m0*5m0*5m0*5m0*0 | m0m00m0m0m0m00m00m000*m0*m0TEGChol |
| hsa-let-7c* MIMAT0004483 | 5'Pm0005f05f05f05f005f0005f05f00*0*5m 0*** | m0m0m0m0m0m0m0m0m0m00m0*m0TEGChol |
| hsa-let-7d MIMAT0000065 | 5'Pm005f05f0f05f05f05f0f0000f05m0*0*5m0 *5m0*5m0*5m0* | m0m0m0m0m0m0m00m0000m000*m0*m0TEGChol |
| hsa-let-7d* MIMAT0004484 | 5'Pm005f00f00005f05f000f05m0*0*5m0*5m 0*5m0*0*0 | m0m0m0m00m0m00m00m00m0m0m0m00*m0*m0TEGChol |
| hsa-let-7e MIMAT0000066 | 5'Pm0005f0f005f05f05f005f00f00*0*5m0*0* f0*5m0*0 | m0m00m0m00m000m00m00m0*m0*m0TEGChol |
| hsa-let-7e* MIMAT0004485 | 5'Pm05f000f0000f00005f05m0*0*5m0*5m0 *** | m0m0m0m0m0m0m0m0m0m0m0*0*m0TEGChol |
| hsa-let-7f MIMAT0000067 | 5'Pm05f000f05f05f05f05f05f000f00*0*0*f 0*0*0 | m0m0m0m00m0000m0m0*0*m0TEGChol |
| hsa-let-7f-1* MIMAT0004486 | 5'Pm00005f005f05f0f005f005f05m0*0* 5m0*5m0*5m0*0 | m0m00m0m000m0m0m0*m0*m0TEGChol |
| hsa-let-7f-2* MIMAT0004487 | 5'Pm0005f0f05f005f05f0005f00*5m0*5m 0*0*f0*0*0 | m0m00m0m00m00m00m0*m0*m0TEGChol |
| hsa-let-7g MIMAT0000414 | 5'Pm00005f005f05f0f05f05f05f05f05m0*5m 0*0*0*f0*0*0 | m0m0000m000m0m0m0*m0*m0TEGChol |
| hsa-let-7g* MIMAT0004584 | 5'Pm0000f05f05f005f05f05f05f00*5m0*0 *5m0*0*0 | m0m000m0m0m0m0*m0*m0TEGChol |
| hsa-let-7i MIMAT0000415 | 5'Pm05f05f05f05f0f0000f0000f05m0*0*5m0*5 m0*5m0*5m0*0 | m0m0m0m0m0m0m0m0m000*0*m0TEGChol |

TABLE 5-continued

Examples of chemical modification patterns

| miRNA Name | Example of modified AS strand | Example of modified sense strand |
|---|---|---|
| hsa-let-7i* MIMAT0004585 | 5'Pm05f000f005f05f05f05f000f00*5m0*0*0*f0*5m0*0 | m0m0m0m00m000m0m0m0m0*0*m0TEGChol |
| hsa-miR-1 MIMAT0000416 | 5'Pm00005f05f05f05f05f05f005f00*0*0*5m0*5m0*0*0 | m0m0m000m0000m0m0m0*m0*m0TEGChol |
| hsa-miR-100 MIMAT0000098 | 5'Pm005f05f05f005f05f0005f05f00*0*0*5m0*0*0 | m0m0m0m0m00m000m000*m0*m0TEGChol |
| hsa-miR-100* MIMAT0004512 | 5'Pm005f05f0f05f005f05f05f005f05m0*5m0*0*0*5m0*5m0*0 | m0m00m00m0m00m000*m0*m0TEGChol |
| hsa-miR-101 MIMAT0000099 | 5'Pm0000f05f05f05f05f05f005f00*5m0*0*5m0*5m0*5m0*0 | m0m0m000m0m0m0m0*m0*m0TEGChol |
| hsa-miR-101* MIMAT0004513 | 5'Pm05f000f005f00f05f0005f05m0*5m0*0*5m0*f0*5m0*0 | m0m0m0m00m0m00m0m0m0*0*m0TEGChol |
| hsa-miR-103 MIMAT0000101 | 5'Pm005f05f0f05f000f0005f05f00*5m0*5m0*0*f0*0*0 | m0m00m0m00m0m000m0m0*m0*m0TEGChol |
| hsa-miR-103-2* MIMAT0009196 | 5'Pm05f05f05f0f005f05f05f05f05f05f00*0*0*0*f0*5m0*0 | m0m0000m000m0m000*0*m0TEGChol |
| hsa-miR-103-as MIMAT0007402 | 5'Pm0005f05f05f05f0f0000f05m0*0*5m0*5m0*f0*5m0*0 | m0m0m0m0m0000m00m0*m0*m0TEGChol |
| hsa-miR-105 MIMAT0000102 | 5'Pm0000f05f05f05f0f0005f0f05m0*5m0*5m0*0*f0* | m0m0m0m00m0000m0m0m0*m0*m0TEGChol |
| hsa-miR-105* MIMAT0004516 | 5'Pm0005f0f05f05f05f05f05f000f00*0*5m0*5m0*5m0*5m0*0 | m0m0m0m0m0000m0m0m0*m0*m0TEGChol |
| hsa-miR-106a MIMAT0000103 | 5'Pm05f000f05f0005f05f05f00*5m0*0*0*5m0*0*0 | m0m00m00m0m0m0m0m0*0*m0TEGChol |
| hsa-miR-106a* MIMAT0004517 | 5'Pm0005f0f005f005f05f05f0m*5m0*0*0*5m0*5m0*0 | m0m000m0m00m0m00m0*m0*m0TEGChol |
| hsa-miR-106b MIMAT0000680 | 5'Pm0000f05f005f05f05f05f05f05m0*5m0*5m0*0*f0*0 | m0m0000m00m00m0m0*m0*m0TEGChol |
| hsa-miR-106b* MIMAT0004672 | 5'Pm0000f05f05f05f05f05f000f00*0*5m0*0*f0*5m0*0 | m0m0m0m00m0000m0m0*m0*m0TEGChol |
| hsa-miR-107 MIMAT0000104 | 5'Pm0005f0f05f005f05f05f05f0f00*0*0*5m0*5m0*5m0* | m0m0m0m00m00m00m0*m0*m0TEGChol |
| hsa-miR-10a MIMAT0000253 | 5'Pm0005f0f00005f05f05f0f00*0*0*5m0*0*0 | m0m0000m0m0m00m00m0*m0*m0TEGChol |
| hsa-miR-10a* MIMAT0004555 | 5'Pm0005f0f0000f05f05f05f0f00*0*5m0*0*f0*5m0*0 | m0m0000m0m0m0m0m0*m0*m0TEGChol |
| hsa-miR-10b MIMAT0000254 | 5'Pm0005f0f05f05f0f00005f05m0*5m0*0*5m0*f0*5m0*0 | m0m0m0m0m0m0m0m00m0*m0*m0TEGChol |
| hsa-miR-10b* MIMAT0004556 | 5'Pm05f05f005f005f05f05f00005f05m0*5m0*5m0*0*5m0*5m0*0 | m0m0m0m000m0m0m00*0*m0TEGChol |
| hsa-miR-1178 MIMAT0005823 | 5'Pm00005f05f05f05f05f05f005f05m0*0*5m0*5m0*5m0*5m0*0 | m0m0m0m0m0000m0m0*m0*m0TEGChol |
| hsa-miR-1179 MIMAT0005824 | 5'Pm005f05f0f00005f05f000f05m0*5m0*0*5m0*f0*0*0 | m0m0m0m00m0m0m0m000*m0*m0TEGChol |
| hsa-miR-1180 MIMAT0005825 | 5'Pm05f000f05f000f005f05f05f05m0*5m0*0*0*f0*0*0 | m0m000m00m0m00m0m0*0*m0TEGChol |
| hsa-miR-1181 MIMAT0005826 | 5'Pm05f000f005f05f05f0000f00*0*5m0*5m0*5m0*5m0*0 | m0m0m0m00m0000m0m0*0*m0TEGChol |
| hsa-miR-1182 MIMAT0005827 | 5'Pm0000f005f00f05f0005f05m0*0*5m0*5m0*5m0*5m0*0 | m0m0m0m00m0m00m0m0m0*m0*m0TEGChol |
| hsa-miR-1183 MIMAT0005828 | 5'Pm0005f05f005f00f05f05f005f05m0*5m0*0*5m0*5m0*0 | m0m000m00m00m0m0m0*m0*m0TEGChol |
| hsa-miR-1184 MIMAT0005829 | 5'Pm05f05f00f005f00f05f05f05f00*0*0*5m0*f0*0*0 | m0m0000m0m00m0m0m0*0*m0TEGChol |
| hsa-miR-1185 MIMAT0005798 | 5'Pm005f00f05f05f05f0f005f05f05m0*5m0*0*0*5m0*0*0 | m0m000m0m0000m0m00*m0*m0TEGChol |
| hsa-miR-1193 MIMAT0015049 | 5'Pm00005f05f0005f05f005f05m0*0*0*0*5m0*0 | m0m00m00m0m0m0m0m0*m0*m0TEGChol |
| hsa-miR-1197 MIMAT0005955 | 5'Pm05f05f05f0f0000f0000f05m0*0*5m0*5m0*5m0*5m0*0 | m0m0m0m00m0m0m000*0*m0TEGChol |
| hsa-miR-1200 MIMAT0005863 | 5'Pm0000f0005f05f05f05f005f00*0*0*0*f0*5m0*0 | m0m000m00m0m0m0m0*m0*m0TEGChol |
| hsa-miR-1202 MIMAT0005865 | 5'Pm05f05f005f05f05f05f05f0005f05f00*5m0*5m0*5m0*f0*5m0*0 | m0m0m0m0m0000m00*0*m0TEGChol |
| hsa-miR-1203 MIMAT0005866 | 5'Pm00005f0005f0f05f005f05f00*5m0*5m0*0*f0*5m0*0 | m0m00m00m0m0m0m0m0*m0*m0TEGChol |
| hsa-miR-1204 MIMAT0005868 | 5'Pm05f0005f05f05f0f05f05f05f05m0*5m0*5m0*f0*5m0*0 | m0m0m00m00m0m00m0m0*0*m0TEGChol |
| hsa-miR-1205 MIMAT0005869 | 5'Pm05f05f005f05f05f05f0005f05f00*5m0*5m0*5m0*f0*5m0*0 | m0m0m0m0m0000m0m0*0*m0TEGChol |
| hsa-miR-1206 MIMAT0005870 | 5'Pm0005f05f0000f005f005f00*0*0*f0** | m0m0m0m00m0m0m0m0m00m0*m0*m0TEGChol |
| hsa-miR-1207-3p MIMAT0005872 | 5'Pm00005f005f05f0f05f005f00*5m0*5m0*5m0*f0*5m0*0 | m0m000m000m0m0m0m0*m0*m0TEGChol |
| hsa-miR-1207-5p MIMAT0005871 | 5'Pm0005f0f05f000f0000f00*5m0*5m0*5m0*5m0*f0*5m0*0 | m0m0m0m0m0m0m00m00m0*m0*m0TEGChol |

TABLE 5-continued

Examples of chemical modification patterns

| miRNA Name | Example of modified AS strand | Example of modified sense strand |
|---|---|---|
| hsa-miR-1208 MIMAT0005873 | 5'Pm05f05f00f005f00f05f05f05f0f00*0*0*5m0*f0*0*0 | m0m0000m0m00m0m0m00*0*m0TEGChol |
| hsa-miR-122 MIMAT0000421 | 5'Pm05f05f05f0f05f05f05f0f005f00f05m0*0*0*5m0*5m0*5m0*0 | m0m0m00m0m0000m000*0*m0TEGChol |
| hsa-miR-122* MIMAT0004590 | 5'Pm05f05f05f0f05f05f05f0f05f05f0f05m0*5m0*5m0*5m0*f0*5m0*0 | m0m0000m0000m000*0*m0TEGChol |
| hsa-miR-1224-3p MIMAT0005459 | 5'Pm0000f05f000f00005f05m0*0*5m0*0*5m0*0*0 | m0m0m0m0m0m0m0m00m0m0m0*m0*m0TEGChol |
| hsa-miR-1224-5p MIMAT0005458 | 5'Pm00005f005f05f05f05f05f05m0*5m0*0*0*f0*0*0 | m0m0000m0m00m0m0m0*m0*m0TEGChol |
| hsa-miR-1225-3p MIMAT0005573 | 5'Pm05f05f005f05f05f05f05f005f05f00*5m0*5m0*5m0*f0*0*0 | m0m00m0m0000m0m00*0*m0TEGChol |
| hsa-miR-1225-5p MIMAT0005572 | 5'Pm05f000f00005f05f0005f05m0*0*0*0*f0** | m0m0m00m0m0m0m0m0m0m0*0*m0TEGChol |
| hsa-miR-1226 MIMAT0005577 | 5'Pm05f05f00f05f005f0f00005f00*5m0*0*0*f0*5m0*0 | m0m0m0m0m0m00m0m0m00*0*m0TEGChol |
| hsa-miR-1226* MIMAT0005576 | 5'Pm05f05f05f0f0000f0000f05m0*0*5m0*5m0*5m0*5m0*0 | m0m0m0m0m0m0m0m000*0*m0TEGChol |
| hsa-miR-1227 MIMAT0005580 | 5'Pm005f005f00005f005f005f00*5m0*0*5m0*f0*5m0*0 | m0m00m0m0m0m0m0m0m00*m0*m0TEGChol |
| hsa-miR-1228 MIMAT0005583 | 5'Pm0005f0f05f05f005f005f005f00*5m0*5m0*0*5m0*5m0*0 | m0m00m0m0m000m00m0*m0*m0TEGChol |
| hsa-miR-1228* MIMAT0005582 | 5'Pm05f05f00f05f000f0005f0f00*5m0*0*0*5m0*5m0*0 | m0m0m0m0m0m0m0m00m00*0*m0TEGChol |
| hsa-miR-1229 MIMAT0005584 | 5'Pm05f000f05f005f0f05f05f05f00*0*5m0*0*f0*0*0 | m0m000m0m00m0m0m0m0*0*m0TEGChol |
| hsa-miR-1231 MIMAT0005586 | 5'Pm005f05f0f0005f0f0005f05f00*0*0*0*f0*0* | m0m0m0m0m0m0m0m000*m0*m0TEGChol |
| hsa-miR-1233 MIMAT0005588 | 5'Pm005f05f0f0005f0f05f05f05f00*0*5m0*5m0*5m0*5m0*0 | m0m000m0m0m0m000*m0*m0TEGChol |
| hsa-miR-1234 MIMAT0005589 | 5'Pm005f05f05f0000f05f005f0f05m0*0*0*5m0*f0*5m0*0 | m0m00m0m0m0m0m000*m0*m0TEGChol |
| hsa-miR-1236 MIMAT0005591 | 5'Pm05f005f0f05f05f0005f05f05m0*0*0*5m0*5m0*5m0*0 | m0m0000m0m0m0m0m0*0*m0TEGChol |
| hsa-miR-1237 MIMAT0005592 | 5'Pm0000f05f005f05f05f005f0f00*5m0*0*5m0*f0*0*0 | m0m00m0m00m0m0m0m0*m0*m0TEGChol |
| hsa-miR-1238 MIMAT0005593 | 5'Pm05f005f0f05f005f00005f00*5m0*5m0*5m0*5m0*5m0*0 | m0m0m0m0m0m00m00m0*0*m0TEGChol |
| hsa-miR-124 MIMAT0000422 | 5'Pm05f000f005f00f05f005f0f05m0*0*0*5m0*5m0*0*0 | m0m0m0m0m0m0m0m0*0*m0TEGChol |
| hsa-miR-124* MIMAT0004591 | 5'Pm0000f0000f0005f0f00*0*5m0*0*f0*0*0 | m0m00m0m0m0m0m0m0m0m0*m0*m0TEGChol |
| hsa-miR-1243 MIMAT0005894 | 5'Pm005f05f05f05f05f05f005f00f00*5m0*0*0*5m0*5m0*0 | m0m00m0m0m0000m000*m0*m0TEGChol |
| hsa-miR-1244 MIMAT0005896 | 5'Pm005f005f005f00f005f05f05m0*0*0*0*f0*5m0*0 | m0m000m0m00m0m0m00*m0*m0TEGChol |
| hsa-miR-1245 MIMAT0005897 | 5'Pm00005f005f05f05f05f05f05m0*5m0*0*0*f0*0*0 | m0m0000m0m00m0m0m0*m0*m0TEGChol |
| hsa-miR-1246 MIMAT0005898 | 5'Pm05f05f05f0f05f05f005f05f005f0f00*5m0*0*5m0*5m0*0*0 | m0m00m00m0m0m0m000*0*m0TEGChol |
| hsa-miR-1247 MIMAT0005899 | 5'Pm05f005f05f0005f05f05f005f00*5m0*5m0*5m0*5m0*5m0*0 | m0m000m00m0m0m0m00*0*m0TEGChol |
| hsa-miR-1248 MIMAT0005900 | 5'Pm05f000f0005f0f05f005f0f00*0*5m0*5m0*5m0*0*0 | m0m00m0m0m0m0m0m0*0*m0TEGChol |
| hsa-miR-1249 MIMAT0005901 | 5'Pm0000f05f005f05f0005f0f00*5m0*0*5m0*f0*0*0 | m0m00m0m00m0m0m0m0*m0*m0TEGChol |
| hsa-miR-1250 MIMAT0005902 | 5'Pm005f00f005f005f0000f00*5m0*0*0*** | m0m0m0m0m0m0m0m00m0m00*m0*m0TEGChol |
| hsa-miR-1251 MIMAT0005903 | 5'Pm05f005f0f05f05f005f05f05f05f05m0*5m0*5m0*5m0*** | m0m0000m000m0m0*0*m0TEGChol |
| hsa-miR-1252 MIMAT0005944 | 5'Pm05f000f0000f005f00f05m0*0*5m0*0*f0*0*0 | m0m00m0m0m0m0m0m0m0m0*0*m0TEGChol |
| hsa-miR-1253 MIMAT0005904 | 5'Pm05f05f005f0f05f05f005f05f00f05m0*0*5m0*5m0*5m0*5m0*0 | m0m0000m000m0m00m00*0*m0TEGChol |
| hsa-miR-1254 MIMAT0005905 | 5'Pm0005f05f05f000f05f05f05f00*0*5m0*5m0*5m0*0*0 | m0m0000m0000m0m0*m0*m0TEGChol |
| hsa-miR-1255a MIMAT0005906 | 5'Pm05f05f05f05f05f05f05f05f05f05f05f05f05m0*5m0*5m0*5m0*5m0*5m0*0 | m0m0000m0000m000*0*m0TEGChol |
| hsa-miR-1255b MIMAT0005945 | 5'Pm0005f0f005f00f0005f0f05m0*0*0*5m0*f0*0 | m0m0m0m0m0m00m0m0m00*m0*m0TEGChol |
| hsa-miR-1256 MIMAT0005907 | 5'Pm05f005f05f05f05f05f05f05f05f0f05m0*5m0*0*5m0*5m0*0*0 | m0m0000m0000m0m00*0*m0TEGChol |
| hsa-miR-1257 MIMAT0005908 | 5'Pm005f005f05f05f005f005f00*5m0*0*5m0*5m0*5m0*0 | m0m00m0m0m000m0m0*m0*m0TEGChol |
| hsa-miR-1258 MIMAT0005909 | 5'Pm05f005f05f0005f05f005f05m0*5m0*5m0*5m0*5m0*5m0*0 | m0m0m0m00m0m00m0m0m0*0*m0TEGChol |

TABLE 5-continued

Examples of chemical modification patterns

| miRNA Name | Example of modified AS strand | Example of modified sense strand |
|---|---|---|
| hsa-miR-125a-3p MIMAT0004602 | 5'Pm05f005f0f05f005f0f005f05f0f00*0*0*5m0*5m0*0 | m0m000m0m00m00m00m0*0*m0TEGChol |
| hsa-miR-125a-5p MIMAT0000443 | 5'Pm05f005f0f005f00f005f05f0f00*5m0*5m0*5m0*5m0*5m0*0 | m0m000m0m0m0m0m0m0m0*0*m0TEGChol |
| hsa-miR-125b MIMAT0000423 | 5'Pm0000f005f05f05f0f0005f05f05m0*5m0*0*5m0*f0*0*0 | m0m0m0m0m0m0m0m0m0*m0*m0TEGChol |
| hsa-miR-125b-1* MIMAT0004592 | 5'Pm0005f0f0005f05f0000f00*5m0*0*5m0*f0*0*0 | m0m0m0m0m0m0m0m0m00m0*m0*m0TEGChol |
| hsa-miR-125b-2* MIMAT0004603 | 5'Pm0005f0f005f005f05f005f00*5m0*5m0*5m0*f0*0*0 | m0m0m0m0m0m0m0m0m0m0*m0*m0TEGChol |
| hsa-miR-126 MIMAT0000445 | 5'Pm005f005f05f05f05f0f05f05f005f05m0*0*0*5m0*f0*0*0 | m0m000m0000m0m00*m0*m0TEGChol |
| hsa-miR-126* MIMAT0000444 | 5'Pm05f05f05f05f0000f05f05f05f05m0*5m0*0*5m0*5m0*0 | m0m0000m0m0m0m0m000*0*m0TEGChol |
| hsa-miR-1260 MIMAT0005911 | 5'Pm0000f05f0005f00005f05m0*0*5m0*5m0*0*0 | m0m0m0m0m0m0m0m00m0m0*m0*m0TEGChol |
| hsa-miR-1260b MIMAT0015041 | 5'Pm005f005f05f005f05f05f05f05m0*5m0*5m0*5m0*5m0*0*0 | m0m0000m00m00m0m00*m0*m0TEGChol |
| hsa-miR-1261 MIMAT0005913 | 5'Pm0005f05f05f05f05f0f0005f05f05m0*5m0*0*5m0*5m0*5m0*0 | m0m0m0m0m0000m00m0*m0*m0TEGChol |
| hsa-miR-1262 MIMAT0005914 | 5'Pm05f05f00f0000f005f005f05m0*0*5m0*0*f0*0*0 | m0m0m00m0m0m0m0m0m00*0*m0TEGChol |
| hsa-miR-1263 MIMAT0005915 | 5'Pm05f05f005f0005f0f005f05f0f00*0*5m0*5m0*5m0*5m0*0 | m0m000m0m0m0m0m00*0*m0TEGChol |
| hsa-miR-1264 MIMAT0005791 | 5'Pm05f05f05f0f05f005f05f05f0005f05m0*5m0*0*5m0*5m0*5m0*0 | m0m0m0m0m0m0m0m000*0*m0TEGChol |
| hsa-miR-1265 MIMAT0005918 | 5'Pm05f05f05f0f0000f0000f05m0*0*5m0*5m0*5m0*5m0*0 | m0m0m0m0m0m0m0m0m000*0*m0TEGChol |
| hsa-miR-1266 MIMAT0005920 | 5'Pm0000f0000f0005f0f05m0*0*0*5m0*f0*0*0 | m0m00m0m0m0m0m0m0m0m0*m0*m0TEGChol |
| hsa-miR-1267 MIMAT0005921 | 5'Pm00005f005f05f0f05f05f05f0f05m0*0*0*0*f0*0*0 | m0m0000m000m0m0m0*m0*m0TEGChol |
| hsa-miR-1268 MIMAT0005922 | 5'Pm00005f005f005f005f0f00*5m0*0*0*f0*5m0*0 | m0m00m0m00m0m0m0m0*m0*m0TEGChol |
| hsa-miR-1269 MIMAT0005923 | 5'Pm05f05f00f05f000f0000f05m0*0*5m0*5m0*5m0*5m0*0 | m0m0m0m0m0m0m0m00*0*m0TEGChol |
| hsa-miR-1270 MIMAT0005924 | 5'Pm05f005f05f0005f0f05f005f05m0*0*5m0*5m0*f0*0*0 | m0m00m00m0m0m0m00m0*0*m0TEGChol |
| hsa-miR-1271 MIMAT0005796 | 5'Pm00005f05f05f00f05f05f005f05m0*5m0*0*5m0*f0*0*0 | m0m000m0m000m0m0m0*m0*m0TEGChol |
| hsa-miR-1272 MIMAT0005925 | 5'Pm00005f005f005f05f05f05f05m0*5m0*0*0*f0*0*0 | m0m0000m00m0m0m0m0*m0*m0TEGChol |
| hsa-miR-1273 MIMAT0005926 | 5'Pm00005f05f05f005f005f05f0f00*0*0*0*f0*0*0 | m0m00m0m000m0m0m0*m0*m0TEGChol |
| hsa-miR-1273c MIMAT0015017 | 5'Pm05f05f05f05f05f05f05f0f005f005f00*0*0*5m0*5m0*5m0*0 | m0m0m00m0m0000m000*0*m0TEGChol |
| hsa-miR-1273d MIMAT0015090 | 5'Pm05f05f00f005f05f0f005f05f00*5m0*5m0*0*5m0*5m0*0 | m0m0m000m00m0m00*0*m0TEGChol |
| hsa-miR-1273e MIMAT0018079 | 5'Pm0000f0005f05f05f05f005f00*5m0*5m0*0*f0*0*0 | m0m000m00m0m0m0m0*m0*m0TEGChol |
| hsa-miR-127-3p MIMAT0000446 | 5'Pm05f05f05f0f00005f0005f0f05m0*0*0*5m0*f0*0*0 | m0m0m0m0m0m0m0m000*0*m0TEGChol |
| hsa-miR-1274a MIMAT0005927 | 5'Pm05f05f05f05f0000f05f05f05f05f00*0*5m0*5m0*5m0*0*0 | m0m0000m0m0m0m000*0*m0TEGChol |
| hsa-miR-1274b MIMAT0005938 | 5'Pm05f05f05f05f0000f05f05f05f0f00*5m0*5m0*5m0*5m0*5m0*0 | m0m0m0m0m0m0m000*0*m0TEGChol |
| hsa-miR-1275 MIMAT0005929 | 5'Pm05f05f005f05f005f0f05f005f05m0*5m0*5m0*0*5m0*5m0*0 | m0m000m00m0m0m0m0*0*m0TEGChol |
| hsa-miR-127-5p MIMAT0004604 | 5'Pm05f05f05f0f0000f0000f05m0*0*5m0*5m0*5m0*5m0*0 | m0m0m0m0m0m0m000*0*m0TEGChol |
| hsa-miR-1276 MIMAT0005930 | 5'Pm05f05f05f0f05f0005f005f005f05m0*5m0*5m0*5m0*f0*0*0 | m0m00m00m0m0m0m000*0*m0TEGChol |
| hsa-miR-1277 MIMAT0005933 | 5'Pm05f000f005f05f0f05f05f00*5m0*0*5m0*5m0*5m0*0 | m0m0000m000m0m0m0*0*m0TEGChol |
| hsa-miR-1278 MIMAT0005936 | 5'Pm0005f05f05f000f005f05f05f00*0*5m0*f0*0*0 | m0m000m0m00m00m0m0*m0*m0TEGChol |
| hsa-miR-1279 MIMAT0005937 | 5'Pm05f005f05f0f05f05f0f05f05f00*5m0*5m0*5m0*5m0*5m0*0 | m0m0000m0000m00m0*0*m0TEGChol |
| hsa-miR-128 MIMAT0000424 | 5'Pm00005f005f00f0000f00*0*0*5m0*5m0*0*0 | m0m0m0m0m0m00m0m0m0m0*m0*m0TEGChol |
| hsa-miR-1280 MIMAT0005946 | 5'Pm05f000f05f05f00f005f05f05f05m0*5m0*0*0*f0*0*0 | m0m000m0m000m0m0m0*0*m0TEGChol |
| hsa-miR-1281 MIMAT0005939 | 5'Pm05f005f0f05f0005f05f005f05m0*5m0*5m0*5m0*5m0*0 | m0m000m0m00m00m0m0*0*m0TEGChol |
| hsa-miR-1282 MIMAT0005940 | 5'Pm05f005f0f05f0005f05f05f005f05m0*5m0*5m0*5m0*5m0*0 | m0m000m0m0m00m00m0*0*m0TEGChol |

TABLE 5-continued

Examples of chemical modification patterns

| miRNA Name | Example of modified AS strand | Example of modified sense strand |
|---|---|---|
| hsa-miR-1283 MIMAT0005799 | 5'Pm005f005f05f05f05f0f05f005f05f00*0*0*0*f0*0*0 | m0m00m0m0000m0m00*m0*m0TEGChol |
| hsa-miR-1284 MIMAT0005941 | 5'Pm05f05f05f05f005f05f05f005f05f00*5m0*5m0*5m0*f0*0*0 | m0m00m0m000m0m000*0*m0TEGChol |
| hsa-miR-1285 MIMAT0005876 | 5'Pm0000f05f05f05f05f05f05f05m0*5m0*0*f0*0*0 | m0m0000m00m00m0m0m0*m0*m0TEGChol |
| hsa-miR-1286 MIMAT0005877 | 5'Pm0005f05f0005f05f00005f00*0*0*0*f0*5m0* | m0m0m0m0m0m0m0m0m00m0*m0*m0TEGChol |
| hsa-miR-1287 MIMAT0005878 | 5'Pm0005f0f05f05f05f05f05f00f05m0*0*0*0*5m0*5m0*0 | m0m000m0m000m00m0*m0*m0TEGChol |
| hsa-miR-1288 MIMAT0005942 | 5'Pm05f05f005f0005f0f005f05f0f00*0*5m0*5m0*5m0*5m0*0 | m0m000m0m0m0m0m0m00*0*m0TEGChol |
| hsa-miR-1289 MIMAT0005879 | 5'Pm05f05f05f05f005f05f05f05f05f05m0*0*5m0*0*5m0*5m0*0 | m0m0000m00m0m0m000*0*m0TEGChol |
| hsa-miR-129* MIMAT0004548 | 5'Pm05f005f0f0005f05f00005f05m0*5m0*5m0*5m0*f0*0*0 | m0m0m0m0m0m0m0m0m00m0*0*m0TEGChol |
| hsa-miR-1290 MIMAT0005880 | 5'Pm05f05f00f05f05f05f0f00005f05m0*0*5m0*5m0*f0*0* | m0m0m0m0m0m0000m0m00*0*m0TEGChol |
| hsa-miR-1291 MIMAT0005881 | 5'Pm005f005f0005f0f05f05f00f00*0*0*5m0*f0*5m0*0 | m0m000m00m0m0m0m00*m0*m0TEGChol |
| hsa-miR-1292 MIMAT0005943 | 5'Pm0005f0f05f05f05f05f05f05f05f05m0*0*0*0*f0*5m0*0 | m0m0000m0000m00m0*m0*m0TEGChol |
| hsa-miR-1293 MIMAT0005883 | 5'Pm05f05f05f05f05f000f0000f00*0*5m0*0*5m0*5m0*0 | m0m0m0m0m0m00m0m000*0*m0TEGChol |
| hsa-miR-129-3p MIMAT0004605 | 5'Pm05f005f0f05f05f05f00005f00*0*5m0*0*f0*5m0*0 | m0m0m0m0m0m0m000m0m0*0*m0TEGChol |
| hsa-miR-1294 MIMAT0005884 | 5'Pm05f05f05f0f05f0005f005f05m0*5m0*5m0*5m0*f0*0*0 | m0m00m0m0m0m0m000*0*m0TEGChol |
| hsa-miR-1295 MIMAT0005885 | 5'Pm0005f05f05f05f05f00005f00*0*5m0*5m0*5m0*5m0*0 | m0m0m0m0m0m00m0m0m0*m0*m0TEGChol |
| hsa-miR-129-5p MIMAT0000242 | 5'Pm005f05f0f05f05f005f05f05f05f00*0*5m0*0*5m0*0*0 | m0m0000m0m000m000*m0*m0TEGChol |
| hsa-miR-1296 MIMAT0005794 | 5'Pm00005f005f00f05f05f00f00*5m0*5m0*0*** | m0m000m0m00m0m0m0m0*m0*m0TEGChol |
| hsa-miR-1297 MIMAT0005886 | 5'Pm0000f00005f0000f05m0*5m0*5m0*0*f0*0*0 | m0m0m0m0m0m0m0m0m0m0m0*m0*m0TEGChol |
| hsa-miR-1298 MIMAT0005800 | 5'Pm05f05f05f0f05f005f05f005f05f00*5m0*5m0*5m0*** | m0m00m0m000m000*0*m0TEGChol |
| hsa-miR-1299 MIMAT0005887 | 5'Pm005f05f05f05f005f0f0005f05m0*0*0*5m0*5m0*5m0*0 | m0m0m0m0m0m0m000m000*m0*m0TEGChol |
| hsa-miR-1301 MIMAT0005797 | 5'Pm05f0005f05f005f00005f05m0*0*0*5m0*f0*0*0 | m0m0m0m0m0m0m000m0m0*0*m0TEGChol |
| hsa-miR-1302 MIMAT0005890 | 5'Pm0000f05f0005f00005f00*0*5m0*0*f0*5m0*0 | m0m0m0m0m0m0m0m00m0m0*m0*m0TEGChol |
| hsa-miR-1303 MIMAT0005891 | 5'Pm00005f0000f05f005f05f00*0*5m0*0*5m0*5m0*0 | m0m00m00m0m0m0m0m0m0*m0*m0TEGChol |
| hsa-miR-1304 MIMAT0005892 | 5'Pm00005f005f05f0f05f005f0f00*0*5m0*5m0*f0*0*0 | m0m00m000m0m0m0m0*m0*m0TEGChol |
| hsa-miR-1305 MIMAT0005893 | 5'Pm05f05f05f05f005f05f05f05f005f05m0*0*5m0*5m0*f0** | m0m000m000m0m000*0*m0TEGChol |
| hsa-miR-1306 MIMAT0005950 | 5'Pm0000f005f05f0f0005f05m0*5m0*0*5m0*f0*0*0 | m0m00m000m0m0m0m0*m0*m0TEGChol |
| hsa-miR-1307 MIMAT0005951 | 5'Pm00005f05f05f00f05f00f05m0*5m0*0*0*5m0*0*0 | m0m000m00m0m0m0m0*m0*m0TEGChol |
| hsa-miR-130a MIMAT0000425 | 5'Pm005f005f0005f0f05f000f05m0*0*0*5m0*5m0*5m0*0 | m0m00m0m0m0m0m0m00*m0*m0TEGChol |
| hsa-miR-130a* MIMAT0004593 | 5'Pm05f005f0f05f000f0005f0f05m0*5m0*5m0*5m0*5m0*0*0 | m0m00m0m0m0m00m0*0*m0TEGChol |
| hsa-miR-130b MIMAT0000691 | 5'Pm00005f05f05f05f05f05f05f05m0*5m0*0*0*f0*5m0*0 | m0m0000m0m0m0m0*m0*m0TEGChol |
| hsa-miR-130b* MIMAT0004680 | 5'Pm05f005f0f05f005f05f05f05f05m0*0*0*5m0*5m0*5m0*0 | m0m000m0m00m0m00m0*0*m0TEGChol |
| hsa-miR-132 MIMAT0000426 | 5'Pm05f05f00f05f05f05f05f0f05f0f05m0*0*5m0*5m0*5m0*0 | m0m00m00m0000m0m00*0*m0TEGChol |
| hsa-miR-132* MIMAT0004594 | 5'Pm05f005f05f05f05f05f05f05f05f05f05m0*5m0*5m0*5m0*** | m0m0000m0000m0m0*0*m0TEGchol |
| hsa-miR-1321 MIMAT0005952 | 5'Pm005f005f005f00f0000f00*5m0*5m0*5m0*5m0*5m0*0 | m0m0m0m0m0m00m0m00m0m0*m0*m0TEGChol |
| hsa-miR-1322 MIMAT0005953 | 5'Pm0000f05f000f005f05f05m0*5m0*0*0*f0*0* | m0m000m00m0m0000m0m0*m0*m0TEGChol |
| hsa-miR-1323 MIMAT0005795 | 5'Pm0005f05f05f0005f05f05f00f00*5m0*5m0*5m0*0*0 | m0m0m0m0m0m0m00m0*m0*m0TEGChol |
| hsa-miR-1324 MIMAT0005956 | 5'Pm0005f0f0005f05f005f05f00*0*5m0*0*5m0*0*0 | m0m00m0m0m0m0m0m0*m0*m0TEGChol |
| hsa-miR-133a MIMAT0000427 | 5'Pm05f005f0f05f05f05f00005f00*5m0*5m0*5m0*f0*5m0*0 | m0m0m0m0m0m0m000m0m00*0*m0TEGChol |

TABLE 5-continued

Examples of chemical modification patterns

| miRNA Name | Example of modified AS strand | Example of modified sense strand |
|---|---|---|
| hsa-miR-133b MIMAT0000770 | 5'Pm005f00f05f05f05f005f00*0*0*5m0*5m0*0 | m0m0m00m0m00m00m0m0*m0*m0TEGChol |
| hsa-miR-134 MIMAT0000447 | 5'Pm005f05f05f05f005f05f05f05f0f05m0*5m0*5m0*0*5m0*0 | m0m0000m00m00m000*m0*m0TEGChol |
| hsa-miR-135a MIMAT0000428 | 5'Pm05f005f05f05f005f05f05f05f05m0*5m0*5m0*0*5m0*5m0*0 | m0m0000m00m00m0m0*0*m0TEGChol |
| hsa-miR-135a* MIMAT0004595 | 5'Pm05f005f05f05f005f05f05f05f05f00*5m0*0*0*f0*0* | m0m0000m00m00m00m0*0*m0TEGChol |
| hsa-miR-135b MIMAT0000758 | 5'Pm05f05f005f0000f0000f00*5m0*0*5m0*5m0*5m0*0 | m0m0m0m0m0m0m0m0m0m00*0*m0TEGChol |
| hsa-miR-135b* MIMAT0004698 | 5'Pm05f05f05f0f0000f0000f05m0*0*5m0*5m0*5m0*5m0*0 | m0m0m0m0m0m0m0m0m000*0*m0TEGChol |
| hsa-miR-136 MIMAT0000448 | 5'Pm05f005f0f05f005f05f05f05f05m0*0*5m0*5m0*5m0*5m0*0 | m0m0m000m0m0m0m00m00m0*0*m0TEGChol |
| hsa-miR-136* MIMAT0004606 | 5'Pm05f05f005f005f00f005f05f05f05m0*0*0*5m0*5m0*5m0*0 | m0m000m0m0m0m0m0m00*0*m0TEGChol |
| hsa-miR-137 MIMAT0000429 | 5'Pm0000f05f000f005f05f05f05m0*5m0*0*0*f0*0*0 | m0m000m0m0m0m0m0m00m0m0*m0*m0TEGChol |
| hsa-miR-138 MIMAT0000430 | 5'Pm05f05f05f05f00005f005f05f05f05m0*5m0*5m0*5m0*5m0*0 | m0m000m0m0m0m0m0m000*0*m0TEGChol |
| hsa-miR-138-1* MIMAT0004607 | 5'Pm05f05f05f05f05f05f005f05f05f005f00*5m0*0*5m0*5m0*5m0*0 | m0m0m000m0m000m000*0*m0TEGChol |
| hsa-miR-138-2* MIMAT0004596 | 5'Pm05f05f05f0f05f005f0f05f000f00*5m0*5m0*0*f0*0*0 | m0m0m0m00m00m00m000*0*m0TEGChol |
| hsa-miR-139-3p MIMAT0004552 | 5'Pm005f005f0005f0f05f0005f05m0*5m0*0*5m0*5m0*0*0 | m0m0m0m0m0m0m0m0m0*m0*m0TEGChol |
| hsa-miR-139-5p MIMAT0000250 | 5'Pm005f05f0f0005f05f005f00f00*5m0*5m0*5m0*5m0*0 | m0m0m00m0m0m0m0m000*m0*m0TEGChol |
| hsa-miR-140-3p MIMAT0004597 | 5'Pm00005f005f05f05f05f05f05f05m0*5m0*0*0*f0*0*0 | m0m0000m000m0m0m0*m0*m0TEGChol |
| hsa-miR-140-5p MIMAT0000431 | 5'Pm05f005f05f0005f05f05f005f00*0*0*5m0*5m0*0 | m0m000m00m0m0m00m0*0*m0TEGChol |
| hsa-miR-141 MIMAT0000432 | 5'Pm0000f005f05f05f0f05f0m0*5m0*5m0*0*5m0*5m0*0 | m0m00m0m000m0m0m0m0*m0*m0TEGChol |
| hsa-miR-141* MIMAT0004598 | 5'Pm05f005f0f05f000f0005f0f05m0*5m0*5m0*5m0*5m0*0 | m0m0m0m0m0m0m0m00m00*0*m0TEGChol |
| hsa-miR-142-3p MIMAT0000434 | 5'Pm05f0005f005f005f05f005f0f0*0*0*5m0*5m0*5m0*0 | m0m00m00m0m00m0m0m0*0*m0TEGChol |
| hsa-miR-142-5p MIMAT0000433 | 5'Pm05f000f05f000f05f005f05f00*5m0*5m0*5m0*5m0*0 | m0m0m0m0m0m0m0m0m0*0*m0TEGChol |
| hsa-miR-143 MIMAT0000435 | 5'Pm05f0005f0005f0f05f05f05f0f05m0*5m0*0*5m0*f0*0 | m0m0000m00m0m0m0m0*0*m0TEGChol |
| hsa-miR-143* MIMAT0004599 | 5'Pm005f00f005f005f0000f05m0*0*0*5m0*f0** | m0m0m0m0m0m0m0m0m0m00*m0*m0TEGChol |
| hsa-miR-144 MIMAT0000436 | 5'Pm00005f005f05f05f05f05f05f05m0*5m0*0*0*f0*0*0 | m0m0000m000m0m0m0*m0*m0TEGChol |
| hsa-miR-144* MIMAT0004600 | 5'Pm00005f05f05f00f05f0005f00*0*0*5m0*f0*0* | m0m00m00m0m000m0m0*m0*m0TEGChol |
| hsa-miR-145 MIMAT0000437 | 5'Pm005f05f05f05f005f0f0005f05m0*0*0*5m0*5m0*0 | m0m0m0m00m00m000*m0*m0TEGChol |
| hsa-miR-145* MIMAT0004601 | 5'Pm0005f0f05f000f05f005f0f00*0*5m0*0*5m0*5m0*0 | m0m0m0m0m0m0m0m0m0*m0*m0TEGChol |
| hsa-miR-1468 MIMAT0006789 | 5'Pm00005f05f05f005f005f05f05f00*0*0*f0*0*0 | m0m000m0m0m0m0m0m0*m0*m0TEGChol |
| hsa-miR-1469 MIMAT0007347 | 5'Pm0005f05f005f05f05f005f05m0*0*5m0*5m0*f0*0 | m0m0m000m00m0m0*m0*m0TEGChol |
| hsa-miR-146a MIMAT0000449 | 5'Pm05f05f05f0f0000f0000f05m0*0*5m0*5m0*5m0*5m0*0 | m0m0m0m0m0m0m0m0m000*0*m0TEGChol |
| hsa-miR-146a* MIMAT0004608 | 5'Pm005f05f0f05f005f05f005f00*0*5m0*5m0*5m0*5m0*0 | m0m0m0m0m0m0m0m000*m0*m0TEGChol |
| hsa-miR-146b-3p MIMAT0004766 | 5'Pm00005f05f05f05f05f005f00*5m0*0*0*f0*0*0 | m0m00m0m0000m0m0m0*m0*m0TEGChol |
| hsa-miR-146b-5p MIMAT0002809 | 5'Pm00005f005f05f05f05f05f05f05m0*0*0*5m0*0*0 | m0m0000m000m0m0m0*m0*m0TEGChol |
| hsa-miR-147 MIMAT0000251 | 5'Pm005f05f0f05f05f05f0f05f000f00*0*0*f0*5m0*0 | m0m0m0m00m0000m000*m0*m0TEGChol |
| hsa-miR-1470 MIMAT0007348 | 5'Pm005f05f0f05f05f05f0f00005f05m0*0*0*0*5m0*5m0*0 | m0m0m0m0m0m0m0m000*m0*m0TEGChol |
| hsa-miR-1471 MIMAT0007349 | 5'Pm05f05f00f005f05f05f05f05f05m0*0*5m0*5m0*f0*0* | m0m000m0m0m0m0m0m0*0*m0TEGChol |
| hsa-miR-147b MIMAT0004928 | 5'Pm05f05f005f05f05f005f0000f00*0*0*5m0*f0*0 | m0m0m0m0m0m0m0m000*0*m0TEGChol |
| hsa-miR-148a MIMAT0000243 | 5'Pm05f05f05f05f05f005f0f005f005f00*5m0*5m0*** | m0m00m00m00m00m000*0*m0TEGChol |
| hsa-miR-148a* MIMAT0004549 | 5'Pm0005f0f05f0005f05f05f0f05m0*5m0*5m0*0*5m0*0*0 | m0m000m0m00m00m00m0*m0*m0TEGChol |

TABLE 5-continued

Examples of chemical modification patterns

| miRNA Name | Example of modified AS strand | Example of modified sense strand |
| --- | --- | --- |
| hsa-miR-148b MIMAT0000759 | 5'Pm05f05f05f05f05f05f05f05f0000f05m0*5m0*0*5m0*5m0*5m0*0 | m0m0m0m0m0m0000m000*0*m0TEGChol |
| hsa-miR-148b* MIMAT0004699 | 5'Pm00005f05f05f05f0f0005f00*5m0*5m0*5m0*5m0*0*0 | m0m0m0m0m0m0000m0m0m0*m0*m0TEGChol |
| hsa-miR-149 MIMAT0000450 | 5'Pm05f05f00f005f00f05f000f00*5m0*0*0*f0*0*0 | m0m0m0m00m0m00m0m0m00*0*m0TEGChol |
| hsa-miR-149* MIMAT0004609 | 5'Pm005f05f05f0005f05f005f005f00*5m0*0*5m0*f0*5m0*0 | m0m0m00m0m00m0m0m0m000*m0*m0TEGChol |
| hsa-miR-150 MIMAT0000451 | 5'Pm05f000f05f05f05f0f005f05f05m0*0*0*f0*0*0 | m0m0m000m0000m0m0m0*0*m0TEGChol |
| hsa-miR-150* MIMAT0004610 | 5'Pm05f05f05f05f05f05f05f05f05f05f0f05m0*0*0*5m0*5m0*0 | m0m0000m0000m000*0*m0TEGChol |
| hsa-miR-151-3p MIMAT0000757 | 5'Pm05f05f05f05f005f05f05f0005f05m0*0*5m0*5m0*f0*0*0 | m0m00m0m000m0m000*0*m0TEGChol |
| hsa-miR-151-5p MIMAT0004697 | 5'Pm05f05f05f05f005f05f0f005f05m0*0*5m0*5m0*5m0*5m0*0 | m0m00m0m000m0m000*0*m0TEGChol |
| hsa-miR-152 MIMAT0000438 | 5'Pm05f05f00f05f000f05f05m0f00*0*5m0*5m0*f0*0*0 | m0m0m0m0m0m0m00m0m00*0*m0TEGChol |
| hsa-miR-153 MIMAT0000439 | 5'Pm0000f0005f05f05f05f00f00*5m0*5m0*0*f0*0*0 | m0m000m00m0m0m0m0m0*m0*m0TEGChol |
| hsa-miR-1537 MIMAT0007399 | 5'Pm0000f0000f05f0005f05m0*0*0*5m0*5m0*5m0*0 | m0m0m0m0m0m0m0m0m0m0*m0*m0TEGChol |
| hsa-miR-1538 MIMAT0007400 | 5'Pm05f005f0f05f000f0000f05m0*0*0*5m0*5m0*5m0*0 | m0m0m0m0m0m0m0m00m00*0*m0TEGChol |
| hsa-miR-1539 MIMAT0007401 | 5'Pm05f05f05f05f005f05f0f05f05f005f05m0*0*5m0*5m0*f0*5m0* | m0m000m000m0m000*0*m0TEGChol |
| hsa-miR-154 MIMAT0000452 | 5'Pm05f05f00f0005f05f0005f0f05m0*5m0*5m0*5m0*5m0*0 | m0m0m0m0m00m0m0m0m00*0*m0TEGChol |
| hsa-miR-154* MIMAT0000453 | 5'Pm00005f005f05f05f005f05f05f05f00*5m0*0*5m0*f0*0*0 | m0m000m0m0m0m0m0m0*m0*m0TEGChol |
| hsa-miR-155 MIMAT0000646 | 5'Pm0000f05f05f00f005f00f00*0*0*5m0*5m0*5m0*0 | m0m00m0m0m000m0m0m0*m0*m0TEGChol |
| hsa-miR-155* MIMAT0004658 | 5'Pm005f00f0005f05f0000f05m0*0*0*5m0*5m0*0 | m0m0m0m0m0m0m0m0m00*m0*m0TEGChol |
| hsa-miR-15a MIMAT0000068 | 5'Pm05f0005f05f005f00005f00*5m0*0*5m0*f0*5m0*0 | m0m0m0m0m000m0m0m0*0*m0TEGChol |
| hsa-miR-15a* MIMAT0004488 | 5'Pm0000f05f05f05f0f05f05f00f00*0*0*f0*0*0 | m0m000m0000m0m0m0*m0*m0TEGChol |
| hsa-miR-15b MIMAT0000417 | 5'Pm005f0000f005f05f0f0f00*5m0*5m0*0*f0*0*0 | m0m0m0m0m0m0m0m00*m0*m0TEGChol |
| hsa-miR-15b* MIMAT0004586 | 5'Pm00005f05f05f05f05f05f05f05f00*0*5m0*5m0*5m0*5m0*0 | m0m0000m0000m0m0m0*m0*m0TEGChol |
| hsa-miR-16 MIMAT0000069 | 5'Pm05f005f0f0000f0000f05m0*5m0*5m0*5m0*5m0*5m0*0 | m0m0m0m0m0m0m0m0m00*0*m0TEGChol |
| hsa-miR-16-1* MIMAT0004489 | 5'Pm05f005f0f05f005f0f05f005f0f05m0*5m0*0*5m0*f0*0 | m0m00m00m00m0m00m0*0*m0TEGChol |
| hsa-miR-16-2* MIMAT0004518 | 5'Pm005f00f00005f0000f00*0*0*5m0*5m0*5m0*0 | m0m0m0m0m0m0m0m0m00*m0*m0TEGChol |
| hsa-miR-17 MIMAT0000070 | 5'Pm05f05f00f005f05f05f0000f05m0*5m0*0*0*f0*0*0 | m0m0m0m0m000m0m0m00*0*m0TEGChol |
| hsa-miR-17* MIMAT0000071 | 5'Pm005f005f005f05f05f00f00*5m0*5m0*0*5m0*0*0 | m0m000m000m0m00*m0*m0TEGChol |
| hsa-miR-181a MIMAT0000256 | 5'Pm005f005f0000f05f0005f00*0*0*5m0*5m0*0*0 | m0m0m0m00m0m0m0m0m00*m0*m0TEGChol |
| hsa-miR-181a* MIMAT0000270 | 5'Pm05f0005f005f005f05f005f0f00*0*0*5m0*5m0*5m0*0 | m0m0m0m00m0m0m0m0m00*0*m0TEGChol |
| hsa-miR-181a-2* MIMAT0004558 | 5'Pm0005f05f05f05f005f05f005f0f05m0*5m0*5m0*5m0*0*0 | m0m00m00m000m0m0m0*m0*m0TEGChol |
| hsa-miR-181b MIMAT0000257 | 5'Pm05f05f00f05f05f05f05f05f005f05m0*5m0*5m0*5m0*f0*5m0*0 | m0m0m0m0m0m0000m0m00*0*m0TEGChol |
| hsa-miR-181c MIMAT0000258 | 5'Pm0000f0000f05f000f00*0*5m0*5m0*f0*5m0*0 | m0m0m0m0m0m0m0m0m0m0*m0*m0TEGChol |
| hsa-miR-181c* MIMAT0004559 | 5'Pm005f05f0f005f05f05f05f00f00*0*5m0*5m0*5m0*5m0*0 | m0m000m000m0m000*m0TEGChol |
| hsa-miR-181d MIMAT0002821 | 5'Pm05f05f05f05f05f0005f05f05f05f05f00*5m0*0*5m0*5m0*0*0 | m0m0000m0m0m00m000*0*m0TEGChol |
| hsa-miR-182 MIMAT0000259 | 5'Pm005f05f05f05f005f05f000f00*5m0*5m0*5m0*5m0*0 | m0m0m0m0m0m0m0m0m000*m0*m0TEGChol |
| hsa-miR-182* MIMAT0000260 | 5'Pm0005f05f05f005f05f05f05f05m0*0*5m0*0*5m0*0*0 | m0m000m0m0m0m0m00*m0*m0TEGChol |
| hsa-miR-1825 MIMAT0006765 | 5'Pm05f000f05f000f0005f0f00*0*5m0*0*5m0*0*0 | m0m00m0m0m0m0m0m0m0*0*m0TEGChol |
| hsa-miR-1827 MIMAT0006767 | 5'Pm005f05f0f005f005f05f05f05f0f00*5m0*5m0*5m0*5m0*0 | m0m000m00m0m000*m0*m0TEGChol |
| hsa-miR-183 MIMAT0000261 | 5'Pm0000f0005f0f0000f00*5m0*0*0*f0*0*0 | m0m0m0m0m0m0m0m0m0m0*m0*m0TEGChol |

TABLE 5-continued

Examples of chemical modification patterns

| miRNA Name | Example of modified AS strand | Example of modified sense strand |
|---|---|---|
| hsa-miR-183* MIMAT0004560 | 5'Pm0005f0f005f00f05f05f05f0f05m0*0*5m0 *5m0*5m0*5m0*0 | m0m0000m0m00m0m00m0*m0*m0TEGChol |
| hsa-miR-184 MIMAT0000454 | 5'Pm05f005f0f05f005f05f05f05f0f05m0*5 m0*0*5m0*5m0*5m0*0 | m0m0000m00m00m00m0*0*m0TEGChol |
| hsa-miR-185 MIMAT0000455 | 5'Pm005f05f0f05f005f0f05f0005f00*5m0*5m 0*0*f0*5m0*0 | m0m0m00m00m0m00m000*m0*m0TEGChol |
| hsa-miR-185* MIMAT0004611 | 5'Pm05f0005f005f0f00005f05m0*0*5m0* 0*5m0*0*0 | m0m0m0m0m0m0m00m0m0m0*0*m0TEGChol |
| hsa-miR-186 MIMAT0000456 | 5'Pm0000f05f05f05f05f005f00*0*0*5m0 *f0*5m0*0 | m0m00m0m0m0000m0m0m0*m0*m0TEGChol |
| hsa-miR-186* MIMAT0004612 | 5'Pm05f005f0f05f005f0f05f005f0f05m0*0*0* 5m0*f0*5m0*0 | m0m00m0m00m00m00m0*0*m0TEGChol |
| hsa-miR-187 MIMAT0000262 | 5'Pm005f05f0f0005f05f0005f0f00*5m0*5m0 *5m0*f0*0*0 | m0m00m0m00m0m00m000*m0*m0TEGChol |
| hsa-miR-187* MIMAT0004561 | 5'Pm0000f05f005f0f00005f00*5m0*5m0*0* 5m0*5m0*0 | m0m0m0m0m00m00m0m0m0*m0*m0TEGChol |
| hsa-miR-188-3p MIMAT0004613 | 5'Pm0000f05f05f05f05f0000f00*5m0*0*0*f0 *0*0 | m0m0m0m0m0000m0m0m0*m0*m0TEGChol |
| hsa-miR-188-5p MIMAT0000457 | 5'Pm00005f05f005f05f05f05f00f05m0*5m0* 5m0*0*f0*0*0 | m0m0000m00m00m0m00*m0*m0TEGChol |
| hsa-miR-18a MIMAT0000072 | 5'Pm005f00f05f005f05f0f05f0f05m0*5m0*5 m0*5m0*5m0*0*0 | m0m000m0m0m0m0m0m00*m0*m0TEGChol |
| hsa-miR-18a* MIMAT0002891 | 5'Pm05f0005f005f00f005f05f05f00*0*0*f0 *0*0 | m0m000m0m0m0m0m0m0*0*m0TEGChol |
| hsa-miR-18b MIMAT0001412 | 5'Pm05f05f00f00005f005f05f0f05m0*0*5m0 *5m0*5m0*0*0 | m0m000m0m0m0m0m0m00*0*m0TEGChol |
| hsa-miR-18b* MIMAT0004751 | 5'Pm005f00f05f0005f05f05m0*5m0*0* 5m0*f0*5m0*0 | m0m0m0m0m0m0m00m00*m0*m0TEGChol |
| hsa-miR-190 MIMAT0000458 | 5'Pm05f000f005f05f005f00*5m0*0*0*f 0*0*0 | m0m00m0m00m0m0m0m0*0*m0TEGChol |
| hsa-miR-1908 MIMAT0007881 | 5'Pm05f005f05f05f05f00f0005f05f00*5m0*5 m0*0*f0*0*0 | m0m0m0m0m000m00m0*0*m0TEGChol |
| hsa-miR-1909 MIMAT0007883 | 5'Pm05f05f05f05f05f05f0f05f05f05f05f00*0 *0*0*5m0*5m0*0 | m0m0000m00m00m000*0*m0TEGChol |
| hsa-miR-1909* MIMAT0007882 | 5'Pm05f05f00f0000f0000f05m0*5m0*0*0*** | m0m0m0m0m0m0m0m0m0m00*0*m0TEGChol |
| hsa-miR-190b MIMAT0004929 | 5'Pm05f05f0f05f05f05f05f00f05m0*0*0 *5m0*f0*0*0 | m0m000m00m00m000*m0*m0TEGChol |
| hsa-miR-191 MIMAT0000440 | 5'Pm005f05f0f05f05f00f005f0f00*5m0*0* 5m0*5m0*0* | m0m00m0m00m000*m0*m0TEGChol |
| hsa-miR-191* MIMAT0001618 | 5'Pm05f0005f0000f05f05f005f05m0*0*5m0* 5m0*f0*5m0*0 | m0m0000m0m0m0m0m0m0*0*m0TEGChol |
| hsa-miR-1910 MIMAT0007884 | 5'Pm0000f05f05f05f0f0000f05m0*5m0*5m0 *0*5m0*0*0 | m0m0m0m0m0000m0m0*m0*m0TEGChol |
| hsa-miR-1911 MIMAT0007885 | 5'Pm05f05f005f05f005f05f0005f0f05m0*0*5 m0*0*f0*5m0*0 | m0m00m0m00m00m00m00*0*m0TEGChol |
| hsa-miR-1911* MIMAT0007886 | 5'Pm00005f05f05f005f0005f05f00*5m0*5m0 *5m0*5m0*0 | m0m00m0m000m0m0m00*m0*m0TEGChol |
| hsa-miR-1912 MIMAT0007887 | 5'Pm05f05f00f005f00f00005f05m*0*0*5m0 *5m0*5m0*0 | m0m0m0m0m0m0m0m0m00*0*m0TEGChol |
| hsa-miR-1913 MIMAT0007888 | 5'Pm0000f05f05f005f05f05f05m0*0*0 *f0*0*0 | m0m0m0m000m0m0*m0*m0TEGChol |
| hsa-miR-1914 MIMAT0007889 | 5'Pm0005f05f05f05f05f0f05f05f05f00*0* 0*0*f0*0*0 | m0m0000m0000m0m0*m0*m0TEGChol |
| hsa-miR-1914* MIMAT0007890 | 5'Pm05f005f05f05f05f05f05f05f05f05 m0*5m0*5m0*0*5m0*5m0*0 | m0m0000m0000m00m0*0*m0TEGChol |
| hsa-miR-1915 MIMAT0007892 | 5'Pm05f000f005f05f05f005f005f00*0*0*5 m0*0*0 | m0m00m0m000m0m0m0m0*0*m0TEGChol |
| hsa-miR-1915* MIMAT0007891 | 5'Pm05f005f05f05f005f05f005f05f05m0*5 m0*5m0*5m0*5m0*5m0*0 | m0m0m0m00m00m00m0*0*m0TEGChol |
| hsa-miR-192 MIMAT0000222 | 5'Pm05f05f05f05f00005f05f00f05m0*0*0 *0*f0*5m0*0 | m0m000m00m00m000*0*m0TEGChol |
| hsa-miR-192* MIMAT0004543 | 5'Pm05f005f05f05f00f0005f05f05m0*5m0*5 m0*5m0*f0*0*0 | m0m00m00m0m0m0m0*0*m0TEGChol |
| hsa-miR-193a-3p MIMAT0000459 | 5'Pm005f00f0000f05f000f05m0*0*0*5m0*5 m0*0*0 | m0m0m00m0m0m0m0m00*m0*m0TEGChol |
| hsa-miR-193a-5p MIMAT0004614 | 5'Pm0000f005f005f0005f05f00*0*5m0*5m0 *f0*0*0 | m0m0m0m0m0m0m0m0*m0*m0TEGChol |
| hsa-miR-193b MIMAT0002819 | 5'Pm0005f0f005f05f0000f00*5m0*0*5m0* 5m0*0*0 | m0m0m0m0m0m0m00m0m0*m0*m0TEGChol |
| hsa-miR-193b* MIMAT0004767 | 5'Pm00005f005f05f05f05f05f05f05m*5m 0*5m0*0*f0*0*0 | m0m0000m000m0m0m0*m0*m0TEGChol |
| hsa-miR-194 MIMAT0000460 | 5'Pm00005f005f005f05f05f00f00*0*0*0*5m 0** | m0m000m00m0m0m0m00*m0*m0TEGChol |
| hsa-miR-194* MIMAT0004671 | 5'Pm05f05f05f0f00005f05f005f05f05m0*5m0 *0*5m0*5m0*0*0 | m0m00m00m0m0m0m0m000*0*m0TEGChol |

TABLE 5-continued

Examples of chemical modification patterns

| miRNA Name | Example of modified AS strand | Example of modified sense strand |
|---|---|---|
| hsa-miR-195 MIMAT0000461 | 5'Pm05f05f05f0f0005f0f05f00f00*0*5m*0*f0*5m*0*0 | m0m0m000m00m0m0m000*0*m0TEGChol |
| hsa-miR-195* MIMAT0004615 | 5'Pm0005f0f05f05f005f05f00f00*0*5m0*5m0*f0*0*0 | m0m0m000m0m0m0m00m0*m0*m0TEGChol |
| hsa-miR-196a MIMAT0000226 | 5'Pm05f000f005f005f005f00*5m*0*0*f0*0*0 | m0m0m00m0m0m00m0m0m0m0*0*m0TEGChol |
| hsa-miR-196a* MIMAT0004562 | 5'Pm05f05f05f05f0005f05f05f00f00*0*5m0*5m0*5m0*0*0 | m0m0m000m0m0m0m000*0*m0TEGChol |
| hsa-miR-196b MIMAT0001080 | 5'Pm05f05f00f05f05f05f05f05f05f00*0*5m0*0*5m0*5m0*0 | m0m0000m0000m0m00*0*m0TEGChol |
| hsa-miR-196b* MIMAT0009201 | 5'Pm00005f0000f0000f00*0*0*0*f0*0*0 | m0m0m0m0m0m0m0m0m0m0m0m0*m0*m0TEGChol |
| hsa-miR-197 MIMAT0000227 | 5'Pm0000f05f0005f0005f05f05m0*0*5m0*0*5m0*0*0 | m0m00m0m0m0m00m0m0m0*m0*m0TEGChol |
| hsa-miR-1972 MIMAT0009447 | 5'Pm05f000f05f05f05f0f005f05f05f05m0*5m0*5m0*5m0*5m0*0 | m0m000m0m0000m0m0m0*0*m0TEGChol |
| hsa-miR-1973 MIMAT0009448 | 5'Pm05f05f005f05f005f0005f05f05m0*5m0*5m0*5m0*5m0*5m0*0 | m0m0m0m0m00m0m0m0m00*0*m0TEGChol |
| hsa-miR-1976 MIMAT0009451 | 5'Pm0000f05f0005f00005f05m0*0*5m0*0*5m0*0*0 | m0m0m0m0m0m0m0m00m0m0m0*m0*m0TEGChol |
| hsa-miR-198 MIMAT0000228 | 5'Pm005f005f05f05f005f05f05f005f05m0*5m0*5m0*0*5m0*5m0*0 | m0m0m000m0m0m000m0m00*m0*m0TEGChol |
| hsa-miR-199a-3p MIMAT0000232 | 5'Pm0005f0f05f05f05f005f05f05f00f00*0*5m0*5m0*f0*0*0 | m0m000m0m000m00m0m00*m0*m0TEGChol |
| hsa-miR-199a-5p MIMAT0000231 | 5'Pm05f05f00f05f05f05f005f05f005f00*0*5m0*0*f0*5m0*0 | m0m00m0m0000m0m00*0*m0TEGChol |
| hsa-miR-199b-3p MIMAT0004563 | 5'Pm05f0005f05f05f05f0f05f005f00f00*5m0*0*0*5m0*5m0*0 | m0m00m0m0000m0m0m0*0*m0TEGChol |
| hsa-miR-199b-5p MIMAT0000263 | 5'Pm0005f0f05f05f05f005f05f05f00f00*0*5m0*5m0*f0*0*0 | m0m000m0m000m00m0m00*m0*m0TEGChol |
| hsa-miR-19a MIMAT0000073 | 5'Pm05f05f005f0000f05f05f05f0f00*0*0*5m0*5m0*0*0 | m0m0000m0m0m0m00m0m0*0*m0TEGChol |
| hsa-miR-19a* MIMAT0004490 | 5'Pm05f0005f05f05f0f05f05f0f05m0*0*5m0*5m0*f0*5m0*0 | m0m000m0m000m0m0m0m0*0*m0TEGChol |
| hsa-miR-19b MIMAT0000074 | 5'Pm005f05f05f05f05f00f0000f05m0*5m0*5m0*5m0*5m0*5m0*0 | m0m0m0m0m0m000m000*m0*m0TEGChol |
| hsa-miR-19b-1* MIMAT0004491 | 5'Pm00005f0005f05f05f05f05f00*5m*5m0*0*5m0*5m0*0 | m0m000m00m0m0m0m0m0*m0*m0TEGChol |
| hsa-miR-19b-2* MIMAT0004492 | 5'Pm0005f05f05f00f0f0000f05m0*5m0*0*5m0*5m0*5m0*0 | m0m0m0m0m0m0m00m0m0m0*m0*m0TEGChol |
| hsa-miR-200a MIMAT0000682 | 5'Pm0005f05f0005f05f05f05f05f05m0*5m0*0*0*5m0*0*0 | m0m0000m00m0m0m0m0*m0*m0TEGChol |
| hsa-miR-200a* MIMAT0001620 | 5'Pm005f005f0000f005f00f00*5m0*5m0*5m0*5m0*5m0*0 | m0m00m0m0m0m0m0m0m00*m0*m0TEGChol |
| hsa-miR-200b MIMAT0000318 | 5'Pm0005f0f05f0005f0f05m0*5m0*0*5m0*5m0*0*0 | m0m00m0m0m0m0m00m0m0*m0*m0TEGChol |
| hsa-miR-200b* MIMAT0004571 | 5'Pm0005f0f05f0005f0f05m0*5m0*0*5m0*5m0*0*0 | m0m00m0m0m0m0m00m0m0*m0*m0TEGChol |
| hsa-miR-200c MIMAT0000617 | 5'Pm005f00f0005f05f05f05f05f0f05m0*0*0*0*f0*0*0 | m0m0m00m0m0m0m00*m0*m0TEGChol |
| hsa-miR-200c* MIMAT0004657 | 5'Pm05f000f00005f05f05f005f00*0*5m0*5m0*5m0*0*0 | m0m0m0m0m0m0m0m0m0*0*m0TEGChol |
| hsa-miR-202 MIMAT0002811 | 5'Pm0000f0005f05f0005f0f00*5m0*5m0*5m0*0*5m0*0*0 | m0m0m00m0m0m0m0m0m0*m0*m0TEGChol |
| hsa-miR-202* MIMAT0002810 | 5'Pm05f0005f005f005f0005f00f00*0*0*5m0*5m0*5m0*0 | m0m00m0m0m0m0m0m00*0*m0TEGChol |
| hsa-miR-203 MIMAT0000264 | 5'Pm0005f0f05f05f05f0f0000f05m0*0*0*** | m0m0m0m0m0000m00m0*m0*m0TEGChol |
| hsa-miR-204 MIMAT0000265 | 5'Pm05f005f0f05f000f05f05f005f05m0*0*5m0*5m0*5m0*5m0*0 | m0m0m0m0m0m0m0m0m0*0*m0TEGChol |
| hsa-miR-205 MIMAT0000266 | 5'Pm0000f05f0005f0005f05f05m0*0*5m0*0*5m0*5m0*0 | m0m0m0m0m0m0m0m0m0*m0*m0TEGChol |
| hsa-miR-205* MIMAT0009197 | 5'Pm05f05f0f05f05f05f05f05f05f05f00*5m0*0*5m0*5m0*5m0*0 | m0m0000m0000m00m0*0*m0TEGChol |
| hsa-miR-2052 MIMAT0009977 | 5'Pm05f05f00f0000f05f05f00*0*5m0*0*f0*5m0*0 | m0m000m0m0m0m00m0m0*0*m0TEGChol |
| hsa-miR-2053 MIMAT0009978 | 5'Pm05f05f05f0f05f005f0f00005f05m0*0*0*f0*0*0 | m0m0m0m0m0m0m0m000*0*m0TEGChol |
| hsa-miR-2054 MIMAT0009979 | 5'Pm05f05f05f0f005f05f0005f0f00*0*0*0*5m0** | m0m0m0m000m000*0*m0TEGChol |
| hsa-miR-206 MIMAT0000462 | 5'Pm005f05f05f0000f0005f05f00*5m0*5m0*0*f0*5m0*0 | m0m00m0m0m0m0m0m0m000*m0*m0TEGChol |
| hsa-miR-208a MIMAT0000241 | 5'Pm05f05f00f00005f05f05f05f00*0*0*5m0*5m0*5m0*0 | m0m000m0m0m0m0m0m0*0*m0TEGChol |
| hsa-miR-208b MIMAT0004960 | 5'Pm0000f05f05f005f00005f00*0*0*5m0*f0*0*0 | m0m0m0m0m0m0m000m0m0m0*m0*m0TEGChol |

TABLE 5-continued

Examples of chemical modification patterns

| miRNA Name | Example of modified AS strand | Example of modified sense strand |
|---|---|---|
| hsa-miR-20a MIMAT0000075 | 5'Pm05f000f0005f05f0000f05m0*5m0*0*0*f0** | m0m0m0m0m0m00m0m0m0m0m0*0*m0TEGChol |
| hsa-miR-20a* MIMAT0004493 | 5'Pm00005f005f05f05f05f05f005f00*5m0*5m0*5m0*5m0*0 | m0m0m000m000m0m0m0m0*m0*m0TEGChol |
| hsa-miR-20b MIMAT0001413 | 5'Pm05f05f05f0f05f05f005f05f05f05m0*5m0*0*0*** | m0m00m00m0m000m000*0*m0TEGChol |
| hsa-miR-20b* MIMAT0004752 | 5'Pm05f05f005f00005f05f05f05f0f00*5m0*5m0*0*5m0*0 | m0m0000m0m0m0m0m0m00*0*m0TEGChol |
| hsa-miR-21 MIMAT0000076 | 5'Pm005f05f0f005f05f05f05f00f00*0*0*0*f0*5m0*0 | m0m000m000m0m0m000*m0*m0TEGChol |
| hsa-miR-21* MIMAT0004494 | 5'Pm05f005f0f00005f05f05f005f00*5m0*0*0*f0*5m0*0 | m0m000m0m0m0m0m0m00*0*m0TEGChol |
| hsa-miR-210 MIMAT0000267 | 5'Pm05f05f005f005f00f05f05f05f05m0*0*5m0*5m0*f0*5m0*0 | m0m0m0m00m0m0m0m00*0*m0TEGChol |
| hsa-miR-211 MIMAT0000268 | 5'Pm05f005f0f05f000f05f05f005f05m0*0*5m0*5m0*5m0*5m0*0 | m0m000m0m0m0m00m0m0*0*m0TEGChol |
| hsa-miR-2110 MIMAT0010133 | 5'Pm05f05f005f05f005f0f05f05f05m0*0*0*0*5m0*0*0 | m0m00m00m0m00m0m00*0*m0TEGChol |
| hsa-miR-2113 MIMAT0009206 | 5'Pm00005f05f05f05f05f00005f05m0*0*0*0*f0*0* | m0m0m0m0m0m0000m0m0m0*m0*m0TEGChol |
| hsa-miR-2114 MIMAT0011156 | 5'Pm0005f0f05f05f05f05f05f05f05f0f05m0*5m0*0*5m0*5m0*0 | m0m0000m0000m00m0m*m0*m0TEGChol |
| hsa-miR-2114* MIMAT0011157 | 5'Pm0005f05f00005f05f05f00f00*0*0*5m0*5m0*0*0 | m0m000m0m0m0m0m0m00*m0*m0TEGChol |
| hsa-miR-2115 MIMAT0011158 | 5'Pm0005f05f05f05f00f05f05f00f00*0*0*5m0*5m0*0*0 | m0m0m00m000m0m0m0*m0*m0TEGChol |
| hsa-miR-2115* MIMAT0011159 | 5'Pm05f05f05f05f05f05f05f05f0005f0f00*5m0*5m0*5m0*5m0*5m0*5m0*0 | m0m00m0m0m0000m000*0*m0TEGChol |
| hsa-miR-2116 MIMAT0011160 | 5'Pm00005f0005f005f05f05f05f05f00*5m0*5m0*0*5m0*5m0*0 | m0m0000m00m0m0m0m0*m0*m0TEGChol |
| hsa-miR-2116* MIMAT0011161 | 5'Pm0000f005f00f005f05f05f05m0*0*0*5m0*f0*0*0 | m0m00m00m00m0m0m0m0*m0*m0TEGChol |
| hsa-miR-2117 MIMAT0011162 | 5'Pm05f05f05f0005f05f05f005f0f05m0*0*0*0*5m0*0*0 | m0m00m00m0m0m0m000*0*m0TEGChol |
| hsa-miR-212 MIMAT0000269 | 5'Pm05f05f05f0f0005f0f05f000f05m0*0*5m0*0*5m0*5m0*0 | m0m00m00m00m0m0m000*0*m0TEGChol |
| hsa-miR-214 MIMAT0000271 | 5'Pm0005f0f05f05f05f05f05f05f05f05m0*0*0*f0*f0*0 | m0m0000m0000m0m0*m0*m0TEGChol |
| hsa-miR-214* MIMAT0004564 | 5'Pm00005f0005f05f05f000f00*0*5m0*5m0*5m0*0*0 | m0m00m00m00m0m0m0m0m0*m0*m0TEGChol |
| hsa-miR-215 MIMAT0000272 | 5'Pm005f005f05f000f05f05f05f0f00*0*5m0*5m0*** | m0m0000m0m0m0m0m00*m0*m0TEGChol |
| hsa-miR-216a MIMAT0000273 | 5'Pm00005f005f05f05f05f005f00*5m0*5m0*5m0*5m0*0 | m0m000m000m0m0m0*m0*m0TEGChol |
| hsa-miR-216b MIMAT0004959 | 5'Pm05f05f05f05f0005f0f05f000f00*5m0*0*5m0*5m0*0 | m0m00m00m00m0m0m000*0*m0TEGChol |
| hsa-miR-217 MIMAT0000274 | 5'Pm05f05f00f0005f0f05f000f00*5m0*5m0*5m0*5m0*0* | m0m00m00m0m00m0m00*0*m0TEGChol |
| hsa-miR-218 MIMAT0000275 | 5'Pm05f005f0f05f0005f05f005f0f00*0*0*5m0*0*0 | m0m00m0m00m00m0m00*0*m0TEGChol |
| hsa-miR-218-1* MIMAT0004565 | 5'Pm05f0005f0005f0f05f0005f00*5m0*5m0*0*5m0*5m0*0 | m0m00m00m00m0m0m0m0m0*0*m0TEGChol |
| hsa-miR-218-2* MIMAT0004566 | 5'Pm05f05f005f05f005f05f05f05f05m0*5m0*0*5m0*5m0*5m0*0 | m0m0000m00m00m0m00*0*m0TEGChol |
| hsa-miR-219-1-3p MIMAT0004567 | 5'Pm0000f005f00f00005f05m0*5m0*0*** | m0m0m0m0m0m00m0m0m0m0*m0*m0TEGChol |
| hsa-miR-219-2-3p MIMAT0004675 | 5'Pm005f005f05f05f00f005f05f0f05m0*5m0*5m0*0*** | m0m000m00m00m0m00*m0*m0TEGChol |
| hsa-miR-219-5p MIMAT0000276 | 5'Pm0000f005f00f0005f0f00*0*0*f0*0*0 | m0m0m0m0m0m00m0m0m0*m0*m0TEGChol |
| hsa-miR-22 MIMAT0000077 | 5'Pm0000f05f0005f0000f00*5m0*5m0*5m0*5m0*5m0** | m0m0m0m0m0m00m0m0m0*m0*m0TEGChol |
| hsa-miR-22* MIMAT0004495 | 5'Pm00005f05f05f05f05f0005f05m0*5m0*0*f0*5m0*0 | m0m0m0m0m0m0m0m0m00*m0*m0TEGChol |
| hsa-miR-221 MIMAT0000278 | 5'Pm0005f05f05f000f05f05f005f05m0*0*5m0*5m0*f0*5m0*0 | m0m000m00m00m0m0*m0*m0TEGChol |
| hsa-miR-221* MIMAT0004568 | 5'Pm00005f005f05f05f05f05f005f00*5m0*5m0*5m0*5m0*0 | m0m000m00m0m0m0m00*0*m0TEGChol |
| hsa-miR-222 MIMAT0000279 | 5'Pm05f000f05f05f00f005f05f00*0*5m0*0*f0*5m0*0 | m0m00m00m000m0m00*0*m0TEGChol |
| hsa-miR-222* MIMAT0004569 | 5'Pm005f05f05f05f05f05f05f05f00f00*0*5m0*5m0*f0*5m0*0 | m0m00m00m0m000m000*m0*m0TEGChol |
| hsa-miR-223 MIMAT0000280 | 5'Pm05f05f005f005f00f00005f00*0*5m0*0*5m0*0* | m0m0m0m0m0m0m0m0m00*0*m0TEGChol |
| hsa-miR-223* MIMAT0004570 | 5'Pm0000f05f005f0f0005f05f05m0*0*0*0*f0*0*0 | m0m00m0m00m00m0m0m0*m0*m0TEGChol |

TABLE 5-continued

Examples of chemical modification patterns

| miRNA Name | Example of modified AS strand | Example of modified sense strand |
|---|---|---|
| hsa-miR-224 MIMAT0000281 | 5'Pm05f05f05f05f00005f005f05f05m0*0*0*5m0*5m0** | m0m000m0m0m0m0m0m000*0*m0TEGChol |
| hsa-miR-224* MIMAT0009198 | 5'Pm05f05f05f0f05f005f0f005f05f05f05m0*0*0*0*f0*0*0 | m0m000m0m00m00m000*0*m0TEGChol |
| hsa-miR-2276 MIMAT0011775 | 5'Pm05f000f005f05f05f05f000f00*0*0*5m*f0*0*0 | m0m0m0m00m0m0m0m0m0m0*0*m0TEGChol |
| hsa-miR-2277-3p MIMAT0011777 | 5'Pm05f05f00f05f005f0f0000f05m0*0*5m0*5m0*0*0 | m0m0m0m0m0m0m00m0m0m00*0*m0TEGChol |
| hsa-miR-2277-5p MIMAT0017352 | 5'Pm0000f05f05f00f05f05f005f00*0*5m0*f0*0*0 | m0m0m0m0m000m0m0m0m0*m0*m0TEGChol |
| hsa-miR-2278 MIMAT0011778 | 5'Pm05f05f005f05f05f00f05f005f0f00*0*5m0*5m0*f0*5m0*0 | m0m00m0m0m0m0m0m00*0*m0TEGChol |
| hsa-miR-2355-3p MIMAT0017950 | 5'Pm05f005f05f05f005f05f05f05f05m0*5m0*0*0*f0*5m0*0 | m0m000m0m000m0m0m0m0*0*m0TEGChol |
| hsa-miR-2355-5p MIMAT0016895 | 5'Pm05f05f05f05f05f005f05f05f05f05f05m0*5m0*0*5m0*5m0*0*0 | m0m0000m00m00m000*0*m0TEGChol |
| hsa-miR-23a MIMAT0000078 | 5'Pm005f05f05f0000f0000f00*0*5m0*0*f0*0*0 | m0m0m0m0m0m0m0m0m0m000*m0*m0TEGChol |
| hsa-miR-23a* MIMAT0004496 | 5'Pm05f05f05f0f005f05f0f05f0005f05m0*0*5m0*5m0*** | m0m0m0m00m000m0m000*0*m0TEGChol |
| hsa-miR-23b MIMAT0000418 | 5'Pm05f0005f0005f05f05f005f0f05m0*0*5m0*5m0*f0*0*0 | m0m0m00m00m0m0m0m0m0m0m0*0*m0TEGChol |
| hsa-miR-23b* MIMAT0004587 | 5'Pm00005f005f05f05f05f005f00*5m0*5m0*5m0*f0*0*0 | m0m0m000m000m0m0m0m0*m0*m0TEGChol |
| hsa-miR-23c MIMAT0018000 | 5'Pm05f05f05f0f05f0f05f05f05f05f00*0*0*5m0*f0*5m0*0 | m0m0000m00m00m000*0*m0TEGChol |
| hsa-miR-24 MIMAT0000080 | 5'Pm05f05f05f05f0005f0f05f000f00*0*5m0*0*5m0*5m0*0 | m0m0m0m00m00m0m0m000*0*m0TEGChol |
| hsa-miR-24-1* MIMAT0000079 | 5'Pm000005f005f05f05f05f05f00*5m0*5m0*5m0*** | m0m0m000m000m0m0m0m0*m0*m0TEGChol |
| hsa-miR-24-2* MIMAT0004497 | 5'Pm0005f05f005f05f05f05f005f00*5m0*5m0*5m0*** | m0m0m000m000m00m0*m0*m0TEGChol |
| hsa-miR-25 MIMAT0000081 | 5'Pm0005f05f05f05f05f05f0f05f05f05f00*0*0*f0*0*0 | m0m0000m0000m00m0*m0*m0TEGChol |
| hsa-miR-25* MIMAT0004498 | 5'Pm05f000f005f005f05f05f05m0*5m0*5m0*5m0*f0*0*0 | m0m0000m00m00m0m0m0*0*m0TEGChol |
| hsa-miR-26a MIMAT0000082 | 5'Pm0000f05f05f005f05f05f05f0f00*0*0*f0*0*0 | m0m0000m000m0m0m0*m0*m0TEGChol |
| hsa-miR-26a-1* MIMAT0004499 | 5'Pm05f000f05f000f005f05f05f05m0*0*5m0*5m0*5m0* | m0m0m0m0m0m0m0m0m0m0*0*m0TEGChol |
| hsa-miR-26a-2* MIMAT0004681 | 5'Pm05f000f05f000f05f05f05f0f05m0*0*0*f0*0*0 | m0m0000m0m0m0m0m0m0*0*m0TEGChol |
| hsa-miR-26b MIMAT0000083 | 5'Pm005f05f0f05f005f0f05f05f005f05m0*0*0*0*5m0*5m0*0 | m0m000m00m00m00m000*m0*m0TEGChol |
| hsa-miR-26b* MIMAT0004500 | 5'Pm0000f05f05f05f05f0000f00*0*0*0*5m0*0*0 | m0m0m0m0m0m0000m0m0m0*m0*m0TEGChol |
| hsa-miR-27a MIMAT0000084 | 5'Pm0005f05f05f0005f005f005f00*5m0*0*0*5m0*0*0 | m0m00m00m00m0m00m00m0*m0*m0TEGChol |
| hsa-miR-27a* MIMAT0004501 | 5'Pm005f05f05f05f005f0f05f005f05m0*5m0*0*0*f0*5m0*0 | m0m0m000m00m000*m0*m0TEGChol |
| hsa-miR-27b MIMAT0000419 | 5'Pm005f05f05f0000f00005f00*5m0*0*5m0*f0*0*0 | m0m00m0m00m0m0m0m0m000*m0*m0TEGChol |
| hsa-miR-27b* MIMAT0004588 | 5'Pm0005f0f0005f0f005f005f00*5m0*5m0*5m0*5m0*0*0 | m0m00m00m00m0m00m00m0*m0*m0TEGChol |
| hsa-miR-28-3p MIMAT0004502 | 5'Pm05f005f0f0005f05f005f05m0*5m0*5m0*0*f0*0* | m0m00m00m00m00m00m0*0*m0TEGChol |
| hsa-miR-28-5p MIMAT0000085 | 5'Pm0000f05f0005f05f05f00f05m0*0*5m0*0*f0*0*0 | m0m000m0m0m0m0m0m0m0*m0*m0TEGChol |
| hsa-miR-2861 MIMAT0013802 | 5'Pm05f05f05f0f005f05f00005f05m0*0*5m0*5m0*5m0*5m0*0 | m0m0m0m00m0m0m000*0*m0TEGChol |
| hsa-miR-2909 MIMAT0013863 | 5'Pm05f005f0f005f005f05f05f05f0f05m0*5m0*5m0*0*5m0*5m0*0 | m0m0000m0m00m0m0m0*0*m0TEGChol |
| hsa-miR-296-3p MIMAT0004679 | 5'Pm05f0005f05f05f0f00005m0*5m0*0*5m0*5m0*5m0*0 | m0m0m0m00m00m000m0m0m0*0*m0TEGChol |
| hsa-miR-296-5p MIMAT0000690 | 5'Pm05f0005f005f05f05f0005f00*5m0*0*5m0*5m0*0*0 | m0m0m0m00m000m0m0m0m0*0*m0TEGChol |
| hsa-miR-297 MIMAT0004450 | 5'Pm05f0005f005f05f0f00005f00*5m0*0*5m0*5m0*0 | m0m0m0m0m0m0m0m0m0m0*0*m0TEGChol |
| hsa-miR-298 MIMAT0004901 | 5'Pm005f05f0f005f005f05f05f05f05m0*5m0*0*0*f0*5m0*0 | m0m0000m00m0m000*m0*m0TEGChol |
| hsa-miR-299-3p MIMAT0000687 | 5'Pm05f000f0005f0f005f00f00*5m0*5m0*0*5m0*5m0*0 | m0m0m0m0m0m0m0m0m0m0m0*0*m0TEGChol |
| hsa-miR-299-5p MIMAT0002890 | 5'Pm005f00f0005f05f0005f0f05m0*5m0*5m0*5m0*0*0 | m0m00m00m0m0m0m0m00*m0*m0TEGChol |
| hsa-miR-29a MIMAT0000086 | 5'Pm00005f005f00f0000f00*0*0*5m0*** | m0m0m0m0m0m0m00m0m0m0*m0*m0TEGChol |

TABLE 5-continued

Examples of chemical modification patterns

| miRNA Name | Example of modified AS strand | Example of modified sense strand |
|---|---|---|
| hsa-miR-29a* MIMAT0004503 | 5'Pm005f05f0f05f000f05f0005f00*0*5m0*0*f0*0*0 | m0m0m0m00m0m0m00m000*m0*m0TEGChol |
| hsa-miR-29b MIMAT0000100 | 5'Pm0000f0000f0000f00*0*5m0*5m0*5m0*5m0*0 | m0m0m0m0m0m0m0m0m0m0m0*m0*m0TEGChol |
| hsa-miR-29b-1* MIMAT0004514 | 5'Pm00005f05f005f05f05f005f0f05m0*5m0*0*5m0*5m0*5m0*0 | m0m00m0m00m0m0m0m0m00*m0*m0TEGChol |
| hsa-miR-29b-2* MIMAT0004515 | 5'Pm05f05f00f05f005f05f05f000f05m0*5m0*0*5m0*5m0*5m0*0 | m0m0m0m00m00m00m0m00*0*m0TEGChol |
| hsa-miR-29c MIMAT0000681 | 5'Pm0000f05f05f00f005f05f0f00*0*0*0*f0*0*0 | m0m000m0m0m000m0m0m0*m0*m0TEGChol |
| hsa-miR-29c* MIMAT0004673 | 5'Pm05f000f05f05f005f00005f05m0*5m0*0*0*f0*5m0*0 | m0m0m0m0m0m000m0m0m0*0*m0TEGChol |
| hsa-miR-300 MIMAT0004903 | 5'Pm0000f05f005f0f00005f00*0*0*0*5m0*5m0*0 | m0m0m0m0m00m00m0m0m0*m0*m0TEGChol |
| hsa-miR-301a MIMAT0000688 | 5'Pm005f05f0f05f005f0f0000f05m0*0*5m0*5m0*5m0*0*0 | m0m0m0m0m00m00m00m000*m0*m0TEGChol |
| hsa-miR-301b MIMAT0004958 | 5'Pm005f05f0f05f005f0f00005f05m0*0*5m0*5m0*5m0*0*0 | m0m0m0m0m0m0m0m0m000*m0*m0TEGChol |
| hsa-miR-302a MIMAT0000684 | 5'Pm05f0005f0000f05f05f005f05m0*0*5m0*f0*5m0*0 | m0m000m0m0m0m0m0m0m0*0*m0TEGChol |
| hsa-miR-302a* MIMAT0000683 | 5'Pm0005f0f005f005f0005f00*0*0*0*f0*5m0*0 | m0m0m0m0m0m0m0m0m00m0*m0*m0TEGChol |
| hsa-miR-302b MIMAT0000715 | 5'Pm005f005f5f0005f05f05f00f05m0*0*0*5m0*0*0 | m0m000m0m0m00m0m00*m0*m0TEGChol |
| hsa-miR-302b* MIMAT0000714 | 5'Pm0000f05f05f00f005f05f0f00*0*0*0*f0*0*0 | m0m000m0m0m000m0m0m0m0*m0*m0TEGChol |
| hsa-miR-302c MIMAT0000717 | 5'Pm005f00f005f005f05f05f05f00*0*5m0*5m0*f0*0*0 | m0m0000m0m00m0m00*m0*m0TEGChol |
| hsa-miR-302c* MIMAT0000716 | 5'Pm05f000f00005f05f005f05m0*5m0*5m0*5m0*f0*0*0 | m0m00m00m0m0m0m0m0m0*0*m0TEGChol |
| hsa-miR-302d MIMAT0000718 | 5'Pm05f05f05f05f0005f05f00005f00*5m0*5m0*5m0*f0*5m0*0 | m0m0m0m0m0m0m0m000*0*m0TEGChol |
| hsa-miR-302d* MIMAT0004685 | 5'Pm0000f05f05f00f005f05f0f00*0*0*0*f0*0*0 | m0m000m0m000m0m0m0*m0*m0TEGChol |
| hsa-miR-302e MIMAT0005931 | 5'Pm005f00f005f005f05f05f05f0f05m0*0*5m0*5m0*5m0*0*0 | m0m0000m0m00m0m0*m0*m0TEGChol |
| hsa-miR-302f MIMAT0005932 | 5'Pm005f05f0f05f005f0f05f0005f05m0*0*0*5m0*5m0*5m0*0 | m0m0m0m00m00m00m000*m0*m0TEGChol |
| hsa-miR-3065-3p MIMAT0015378 | 5'Pm05f05f00f005f00f05f0005f00*5m0*5m0*5m0*5m0*5m0*0 | m0m0m0m00m00m00m000*0*m0TEGChol |
| hsa-miR-3065-5p MIMAT0015066 | 5'Pm05f000f00005f05f05f00f00*5m0*5m0**** | m0m0000m0m0m0m0m0*0*m0TEGChol |
| hsa-miR-3074 MIMAT0015027 | 5'Pm05f000f00005f00005f00*5m0*5m0*5m0*f0*5m0*0 | m0m0m0m0m0m0m0m0m0m0*0*m0TEGChol |
| hsa-miR-30a MIMAT0000087 | 5'Pm005f00f005f005f05f05f05f0f05m0*0*5m0*5m0*5m0*5m0*0 | m0m0000m0m00m0m00*m0*m0TEGChol |
| hsa-miR-30a* MIMAT0000088 | 5'Pm05f000f0000f0005f05f00*5m0*5m0*5m0*f0*5m0*0 | m0m0m0m0m0m0m0m0m0*0*m0TEGChol |
| hsa-miR-30b MIMAT0000420 | 5'Pm05f000f0000f0005f05f00*5m0*5m0*5m0*f0*5m0*0 | m0m00m0m0m0m0m0m0m0*0*m0TEGChol |
| hsa-miR-30b* MIMAT0004589 | 5'Pm0000f005f05f05f005f00f05m0*5m0*5m0*0*f0*5m0*0 | m0m0m0m0m000m0m0m0*m0*m0TEGChol |
| hsa-miR-30c MIMAT0000244 | 5'Pm005f00f005f005f05f05f05f00*0*5m0*5m0*f0*0*0 | m0m0000m0m00m0m00*m0*m0TEGChol |
| hsa-miR-30c-1* MIMAT0004674 | 5'Pm0005f05f00005f05f005f0f00*0*5m0*5m0*5m0*5m0*0 | m0m0m0m0m00m00m0m0*m0*m0TEGChol |
| hsa-miR-30c-2* MIMAT0004550 | 5'Pm0005f0f0005f05f005f00f05m0*5m0*5m0*0*5m0*5m0*0 | m0m0m0m0m00m00m0m0*m0*m0TEGChol |
| hsa-miR-30d MIMAT0000245 | 5'Pm05f05f05f05f0005f05f00005f00*5m0*5m0*5m0*f0*5m0*0 | m0m0m0m0m0m0m000*0*m0TEGChol |
| hsa-miR-30d* MIMAT0004551 | 5'Pm005f00f005f005f05f05f05f00*0*5m0*5m0*f0*0*0 | m0m0000m0m00m0m00*m0*m0TEGChol |
| hsa-miR-30e MIMAT0000692 | 5'Pm05f05f05f05f0005f05f00005f00*5m0*5m0*5m0*f0*5m0*0 | m0m0m0m0m0m0m0m000*0*m0TEGChol |
| hsa-miR-30e* MIMAT0000693 | 5'Pm0005f0f00005f005f05f0f00*5m0*0*5m0*f0*0*0 | m0m000m0m0m0m0m0m0*m0*m0TEGChol |
| hsa-miR-31 MIMAT0000089 | 5'Pm05f000f005f005f05f05f05m0*5m0*5m0*5m0*f0*0*0 | m0m0000m0m0m0m0*0*m0TEGChol |
| hsa-miR-31* MIMAT0004504 | 5'Pm005f05f0f05f005f05f0005f0f05m0*5m0*5m0*f0*5m0*0 | m0m0m0m00m00m000*m0*m0TEGChol |
| hsa-miR-3115 MIMAT0014977 | 5'Pm05f05f0f005f05f05f05f00*5m0*5m0*f0*0*0 | m0m0m0m0m0m0m0*0*m0TEGChol |
| hsa-miR-3116 MIMAT0014978 | 5'Pm05f05f00f05f05f05f0f005f00f05m0*5m0**** | m0m0m0m00m0000m0m0*0*m0TEGChol |
| hsa-miR-3117 MIMAT0014979 | 5'Pm005f00f05f005f05f0000f00*5m0*0*0*5m0*0*0 | m0m0m0m0m0m0m0m0m0m0*m0*m0TEGChol |

TABLE 5-continued

Examples of chemical modification patterns

| miRNA Name | Example of modified AS strand | Example of modified sense strand |
| --- | --- | --- |
| hsa-miR-3118 MIMAT0014980 | 5'Pm005f05f05f0000f05f005f0f00*5m0*0*0*f0*0*0 | m0m00m0m0m0m0m0m000*m0*m0TEGChol |
| hsa-miR-3119 MIMAT0014981 | 5'Pm05f05f05f05f05f005f005f05f05f00*0*0*5m0*5m0*5m0*0 | m0m000m0m0m00m000*0*m0TEGChol |
| hsa-miR-3120 MIMAT0014982 | 5'Pm005f005f005f05f05f05f05f05f05m0*5m0*0*0*f0*0*0 | m0m0000m000m0m0m00*m0*m0TEGChol |
| hsa-miR-3121 MIMAT0014983 | 5'Pm00005f05f05f00f0000f00*0*0*5m0*f0*5m0*0 | m0m0m0m0m0m0m000m0m0m0*m0*m0TEGChol |
| hsa-miR-3122 MIMAT0014984 | 5'Pm05f05f05f05f05f05f05f05f000f05m0*0*5m0*0*5m0*5m0*0 | m0m00m0m00m0000m000*0*m0TEGChol |
| hsa-miR-3123 MIMAT0014985 | 5'Pm05f0005f005f05f05f005f0f05m0*0*5m0*0*f0*5m0*0 | m0m00m00m000m0m0m0m0*0*m0TEGChol |
| hsa-miR-3124 MIMAT0014986 | 5'Pm00005f0005f05f05f05f05f05m0*5m0*0*0*f0*0*0 | m0m0000m00m0m0m0m0m0*m0*m0TEGChol |
| hsa-miR-3125 MIMAT0014988 | 5'Pm05f05f05f05f005f05f05f05f05f05f00*0*0*5m0*f0*5m0*0 | m0m00m00m000m0m000*0*m0TEGChol |
| hsa-miR-3126-3p MIMAT0015377 | 5'Pm05f0005f005f05f05f005f05f0f05f05m0*0*0*5m0*f0*0*0 | m0m000m0m0m0m0m0m0m0*0*m0TEGChol |
| hsa-miR-3126-5p MIMAT0014989 | 5'Pm0005f0f0005f05f05f05f00f05m0*5m0*5m0*0*5m0*5m0*0 | m0m0m000m00m0m0m00m0*m0*m0TEGChol |
| hsa-miR-3127 MIMAT0014990 | 5'Pm0000f05f05f00f005f05f0f00*0*0*0*f0*0* | m0m000m0m0m0m0m0m0*m0*m0TEGChol |
| hsa-miR-3128 MIMAT0014991 | 5'Pm05f05f05f0f0000f0000f05m0*0*5m0*5m0*5m0*5m0*0 | m0m0m0m0m0m0m0m0m000*0*m0TEGChol |
| hsa-miR-3129 MIMAT0014992 | 5'Pm0005f0f05f05f05f05f05f05f05m0*0*5m0*0*f0*0*0 | m0m0000m00m00m00m0*m0*m0TEGChol |
| hsa-miR-3130-3p MIMAT0014994 | 5'Pm05f000f05f05f05f0f005f005f00*5m0*0*5m0*5m0*5m0*0 | m0m00m00m0000m0m0m0*0*m0TEGChol |
| hsa-miR-3130-5p MIMAT0014995 | 5'Pm05f000f005f05f05f0005f05m0*5m0*0*5m0*5m0*0 | m0m00m00m000m0m0m0m0*0*m0TEGChol |
| hsa-miR-3131 MIMAT0014996 | 5'Pm05f05f05f0f0000f0000f05m0*0*5m0*5m0*5m0*5m0*0 | m0m0m0m0m0m0m0m0m000*0*m0TEGChol |
| hsa-miR-3132 MIMAT0014997 | 5'Pm05f05f05f05f05f05f05f0f05f05f05f05f00*0*5m0*5m0*f0*5m0*0 | m0m0000m0000m000*0*m0TEGChol |
| hsa-miR-3133 MIMAT0014998 | 5'Pm005f05f05f05f05f05f05f05f05f00*0*0*0*5m0*0*0 | m0m0000m0000m000*m0*m0TEGChol |
| hsa-miR-3134 MIMAT0015000 | 5'Pm05f0005f005f05f0f005f0f00*5m0*5m0*0*5m0*5m0*0 | m0m00m0m000m0m0m0m0*0*m0TEGChol |
| hsa-miR-3135 MIMAT0015001 | 5'Pm05f000f05f005f0f0005f0f00*5m0*5m0*5m0*5m0*0*0 | m0m00m00m00m0m0m0m0*0*m0TEGChol |
| hsa-miR-3136 MIMAT0015003 | 5'Pm0005f05f05f000f00005f05m0*5m0*5m0*0*5m0*0*0 | m0m0m0m0m0m0m0m00m00m0*m0*m0TEGChol |
| hsa-miR-3137 MIMAT0015005 | 5'Pm00005f05f000f05f05f00f00*0*0*0*f0** | m0m000m0m0m0m0m0m0*m0*m0TEGChol |
| hsa-miR-3138 MIMAT0015006 | 5'Pm0005f0f05f005f05f05f000f00*0*0*0*f0*0*0 | m0m0m0m00m00m00m0*m0*m0TEGChol |
| hsa-miR-3139 MIMAT0015007 | 5'Pm0000f05f005f05f05f05f05f05m0*5m0*5m0*0*f0*0*0 | m0m0000m00m00m0m0*m0*m0TEGChol |
| hsa-miR-3140 MIMAT0015008 | 5'Pm005f005f05f05f0f05f0005f05m0*0*0*5m0*5m0*5m0*0 | m0m00m00m00m00m00*m0*m0TEGChol |
| hsa-miR-3141 MIMAT0015010 | 5'Pm005f05f05f0000f00005f00*5m0*5m0*0*f0*5m0*0 | m0m00m0m0m0m0m0m000*m0*m0TEGChol |
| hsa-miR-3142 MIMAT0015011 | 5'Pm05f0005f0005f05f05f005f0f05m0*0*5m0*5m0*f0*0*0 | m0m00m0m0m0m0m0m0*0*m0TEGChol |
| hsa-miR-3143 MIMAT0015012 | 5'Pm05f000f00005f05f000f00*0*0*f0*0*0 | m0m0m0m0m0m0m0m0m0*0*m0TEGChol |
| hsa-miR-3144-3p MIMAT0015015 | 5'Pm05f05f00f005f00f05f05f05f0f00*0*5m0*0*** | m0m000m0m00m0m0m00*0*m0TEGChol |
| hsa-miR-3144-5p MIMAT0015014 | 5'Pm005f00f05f000f05f05f05f0f00*0*5m0*5m0*f0*5m0*0 | m0m0000m00m00m00*m0*m0TEGChol |
| hsa-miR-3145 MIMAT0015016 | 5'Pm05f05f05f05f05f005f05f05f005f05m0*5m0*0*0*f0*0*0 | m0m000m00m00m000*0*m0TEGChol |
| hsa-miR-3146 MIMAT0015018 | 5'Pm05f05f0f0000f0000f05m0*0*5m0*5m0*5m0*5m0*0 | m0m0m0m0m0m0m0m0m0m0*0*m0TEGChol |
| hsa-miR-3147 MIMAT0015019 | 5'Pm0000f05f005f05f05f05f05f05m0*5m0*5m0*0*f0*0*0 | m0m00m00m00m0m0*m0*m0TEGChol |
| hsa-miR-3148 MIMAT0015021 | 5'Pm05f05f05f0f05f05f00f0005f05f05m0*5m0*5m0*0*** | m0m0m0m0m0m000m000*0*m0TEGChol |
| hsa-miR-3149 MIMAT0015022 | 5'Pm05f05f05f0f05f000f0000f00*0*5m0*0*f0*0*0 | m0m0m0m00m00m00m000*0*m0TEGChol |
| hsa-miR-3150 MIMAT0015023 | 5'Pm0000f0000f0000f00*5m0*0*0*f0*0* | m0m0m0m0m0m0m0m0m0m0m0*m0*m0TEGChol |
| hsa-miR-3150b MIMAT0018194 | 5'Pm05f05f05f0f05f005f05f05f05f05f00*0*5m0*5m0*0*0 | m0m0000m00m00m000*0*m0TEGChol |
| hsa-miR-3151 MIMAT0015024 | 5'Pm05f05f05f0f05f005f0f05f05f00f05m0*5m0*5m0*0*f0*0*0 | m0m0m000m00m000*0*m0TEGChol |

TABLE 5-continued

Examples of chemical modification patterns

| miRNA Name | Example of modified AS strand | Example of modified sense strand |
|---|---|---|
| hsa-miR-3152 MIMAT0015025 | 5'Pm05f05f05f0f0000f0005f0f05m0*0*5m0*5m0*5m0*5m0*0 | m0m00m0m0m0m0m0m0m000*0*m0TEGChol |
| hsa-miR-3153 MIMAT0015026 | 5'Pm005f05f05f005f05f0f05f05f00f00*0*5m0*f0*5m0*0 | m0m00m000m000m0m000*m0*m0TEGChol |
| hsa-miR-3154 MIMAT0015028 | 5'Pm05f0005f05f005f05f005f05f05m0*5m0*0*5m0*5m0*0*0 | m0m000m0m00m00m0m0*0*m0TEGChol |
| hsa-miR-3155 MIMAT0015029 | 5'Pm05f000f005f05f05f005f005f00*0*5m0*0*5m0*5m0*0 | m0m00m0m000m0m0m0m0*0*m0TEGChol |
| hsa-miR-3156 MIMAT0015030 | 5'Pm0005f05f0005f05f00005f00*0*5m0*5m0*f0*0*0 | m0m0m0m0m00m0m0m0m00m0*m0*m0TEGChol |
| hsa-miR-3157 MIMAT0015031 | 5'Pm0005f0f005f05f05f005f00f05m0*0*5m0*0*5m0*5m0*0 | m0m00m0m000m0m00m0*m0*m0TEGChol |
| hsa-miR-3158 MIMAT0015032 | 5'Pm05f05f005f05f05f00f05f05f005f05m0*5m0*0*0*f0*5m0*0 | m0m0m00m0m000m0m00*0*m0TEGChol |
| hsa-miR-3159 MIMAT0015033 | 5'Pm05f005f0f005f05f0f05f05f0f00*5m0*5m0*0*f0*5m0*0 | m0m0000m000m0m00m0*0*m0TEGChol |
| hsa-miR-3160 MIMAT0015034 | 5'Pm05f05f0f0000f0000f05m0*0*5m0*5m0*5m0*5m0*0 | m0m0m0m0m0m0m0m0m000*0*m0TEGChol |
| hsa-miR-3161 MIMAT0015035 | 5'Pm005f005f0005f05f05f05f05f05m0*0*0*0*f0*5m0* | m0m0000m00m0m0m0m00*m0*m0TEGChol |
| hsa-miR-3162 MIMAT0015036 | 5'Pm005f00f005f05f05f0f05f05f0f00*0*5m0*5m0*f0*5m0*0 | m0m0000m0000m0m0m0*m0*m0TEGChol |
| hsa-miR-3163 MIMAT0015037 | 5'Pm005f00f0005f05f0000f05m0*5m0*0*0*5m0*0*0 | m0m0m0m0m0m0m0m0m0m0m00*m0*m0TEGChol |
| hsa-miR-3164 MIMAT0015038 | 5'Pm005f05f05f0005f05f0005f0f00*5m0*5m0*0*5m0** | m0m00m0m0m0m00m0m000*m0*m0TEGChol |
| hsa-miR-3165 MIMAT0015039 | 5'Pm0000f0000f00005f05m0*5m0*5m0*0*5m0*5m0*0 | m0m0m0m0m0m0m0m0m0m0m0*m0*m0TEGChol |
| hsa-miR-3166 MIMAT0015040 | 5'Pm05f005f05f05f05f05f0005f0f00*0*5m0*0*f0** | m0m00m0m0m0000m0m0*0*m0TEGChol |
| hsa-miR-3167 MIMAT0015042 | 5'Pm05f005f0f0005f05f05f05f0f00*0*5m0*0*f0*0*0 | m0m0000m00m0m00m0*0*m0TEGChol |
| hsa-miR-3168 MIMAT0015043 | 5'Pm005f00f05f05f005f005f05f0f05m0*0*0*0*f0*0*0 | m0m000m0m0m0m0m0m0m00*m0*m0TEGChol |
| hsa-miR-3169 MIMAT0015044 | 5'Pm05f05f00f005f00f005f05f05m0*5m0*0*5m0*f0*5m0*0 | m0m00m0m0m00m0m0m00*0*m0TEGChol |
| hsa-miR-3170 MIMAT0015045 | 5'Pm0005f0f005f05f05f05f05f05f05m0*5m0*5m0*5m0*f0** | m0m0000m000m0m00m0*m0*m0TEGChol |
| hsa-miR-3171 MIMAT0015046 | 5'Pm05f05f05f05f0000f0000f05m0*0*5m0*5m0*5m0*5m0*0 | m0m0m0m0m0m0m0m0m000*0*m0TEGChol |
| hsa-miR-3173 MIMAT0015048 | 5'Pm05f0005f05f005f05f05f05f0f05m0*5m0*5m0*5m0*5m0*0 | m0m000m00m0m00m0m0*0*m0TEGChol |
| hsa-miR-3174 MIMAT0015051 | 5'Pm05f05f00f005f05f0f005f005f05m0*0*5m0*5m0*f0*0* | m0m00m0m00m000m0m00*0*m0TEGChol |
| hsa-miR-3175 MIMAT0015052 | 5'Pm05f0005f0000f0000f00*0*0*5m0*5m0*0*0 | m0m0m0m0m0m0m0m0m0m0m0*0*m0TEGChol |
| hsa-miR-3176 MIMAT0015053 | 5'Pm05f05f00f05f005f0f0005f05m0*0*0*5m0*5m0*5m0*0 | m0m00m00m00m0m0m00*0*m0TEGChol |
| hsa-miR-3177 MIMAT0015054 | 5'Pm05f0005f05f005f05f005f05f05m0*5m0*5m0*5m0*** | m0m000m00m0m00m0m0*0*m0TEGChol |
| hsa-miR-3178 MIMAT0015055 | 5'Pm0000f05f005f05f05f05f05m0*5m0*5m0*0*f0*0*0 | m0m0000m00m0m0m0*m0*m0TEGChol |
| hsa-miR-3179 MIMAT0015056 | 5'Pm05f05f05f0f05f005f05f05f00f05m0*5m0*5m0*5m0*5m0*0 | m0m000m000m0m000*0*m0TEGChol |
| hsa-miR-3180 MIMAT0018178 | 5'Pm05f005f0f0000f0000f05m0*5m0*5m0*5m0*5m0*5m0*0 | m0m0m0m0m0m0m0m0m0m00m0*0*m0TEGChol |
| hsa-miR-3180-3p MIMAT0015058 | 5'Pm05f05f05f05f05f005f05f05f05f0f00*0*0*5m0*5m0*5m0*0 | m0m000m00m00m000*0*m0TEGChol |
| hsa-miR-3180-5p MIMAT0015057 | 5'Pm05f05f05f0f00005f05f05f05f0m0*5m0*0*f0*0*0 | m0m0000m000m0m000*0*m0TEGChol |
| hsa-miR-3181 MIMAT0015061 | 5'Pm05f05f05f05f005f005f005f05f0f00*5m0*0*5m0*5m0*0*0 | m0m000m0m0m0m000*0*m0TEGChol |
| hsa-miR-3182 MIMAT0015062 | 5'Pm0005f0f005f05f05f0f05f0f05m0*0*0*5m0*5m0*5m0*0 | m0m0m00m0m00m00m0*m0*m0TEGChol |
| hsa-miR-3183 MIMAT0015063 | 5'Pm00005f05f05f05f0f05f05f0f00*0*5m0*0*5m0*5m0*0 | m0m000m0000m0m0*m0*m0TEGChol |
| hsa-miR-3184 MIMAT0015064 | 5'Pm005f005f05f05f0f005f0f005f05m0*0*0*0*f0*5m0*0 | m0m0m0m0m0000m0m0*0*m0TEGChol |
| hsa-miR-3185 MIMAT0015065 | 5'Pm005f05f0f05f005f05f05f05f05f05m0*5m0*0*5m0*f0*5m0*0 | m0m000m00m00m000*m0*m0TEGChol |
| hsa-miR-3186-3p MIMAT0015068 | 5'Pm05f005f0f05f005f05f05f05f00*0*0*5m0*5m0*0 | m0m00m0m0m0m0m0m0*0*m0TEGChol |
| hsa-miR-3186-5p MIMAT0015067 | 5'Pm0005f05f05f05f0f005f05f05m0*0*0*5m0*f0*0*0 | m0m000m0000m00m0*m0*m0TEGChol |
| hsa-miR-3187 MIMAT0015069 | 5'Pm05f05f00f05f0005f05f05f005f00*5m0*0*5m0*** | m0m0m0m000m0m00m0m00*0*m0TEGChol |

TABLE 5-continued

Examples of chemical modification patterns

| miRNA Name | Example of modified AS strand | Example of modified sense strand |
|---|---|---|
| hsa-miR-3188 MIMAT0015070 | 5'Pm005f00f0000f005f05f05f05m0*0*5m0*5m0*f0*5m0*0 | m0m000m0m0m0m0m0m0m00*m0*m0TEGChol |
| hsa-miR-3189 MIMAT0015071 | 5'Pm00005f05f005f0f05f05f005f00*5m0*5m0*0*5m0*5m0*0 | m0m0m000m00m00m0m0m0*m0*m0TEGChol |
| hsa-miR-3190 MIMAT0015073 | 5'Pm05f005f05f005f05f0f05f05f00f05m0*5m0*5m0*5m0*f0*0*0 | m0m0m00m0m000m0m00m0*0*m0TEGChol |
| hsa-miR-3191 MIMAT0015075 | 5'Pm00005f005f005f05f005f05f00*5m0*0*5m0*5m0*0* | m0m000m0m0m0m0m0m0m0*m0*m0TEGChol |
| hsa-miR-3192 MIMAT0015076 | 5'Pm05f05f005f005f00f0005f05f05m0*5m0*5m0*5m0*5m0*0 | m0m0m0m0m0m00m0m00*0*m0TEGChol |
| hsa-miR-3193 MIMAT0015077 | 5'Pm0005f05f005f05f05f005f00f05m0*0*0*0*5m0*5m0*0 | m0m00m0m000m0m00m0*m0*m0TEGChol |
| hsa-miR-3194 MIMAT0015078 | 5'Pm05f05f005f05f05f05f0f0005f0f05m0*5m0*0*5m0*5m0*0*0 | m0m00m0m0000m0m00*0*m0TEGChol |
| hsa-miR-3195 MIMAT0015079 | 5'Pm005f005f05f05f05f05f05f000f00*5m0*0*5m0*5m0*0*0 | m0m0m0m00m0000m0m00*m0*m0TEGChol |
| hsa-miR-3196 MIMAT0015080 | 5'Pm005f05f0f005f05f05f05f05f05f05m0*5m0*0*0*f0*5m0*0 | m0m0000m000m0m000*m0*m0TEGChol |
| hsa-miR-3197 MIMAT0015082 | 5'Pm0000f0005f05f005f05f05f05m0*5m0*0*0*5m0*0*0 | m0m000m0m0m0m0m0m0m0*m0*m0TEGChol |
| hsa-miR-3198 MIMAT0015083 | 5'Pm05f0005f05f05f05f0f0005f0f05m0*0*0*5m0*f0*5m0*0 | m0m0m0m0m0m0000m0m0*0*m0TEGChol |
| hsa-miR-3199 MIMAT0015084 | 5'Pm05f05f00f05f000f05f005f05f05m0*0*0*5m0*f0*0*0 | m0m00m00m0m00m00m0*0*m0TEGChol |
| hsa-miR-32 MIMAT0000090 | 5'Pm05f05f00f05f005f005f005m0*5m0*0*5m0*5m0*5m0*0 | m0m0m0m0m00m00m00*0*m0TEGChol |
| hsa-miR-32* MIMAT0004505 | 5'Pm05f000f00005f005f00f05m0*0*5m0*5m0*f0*5m0*0 | m0m00m0m0m0m0m0m0m0m0*0*m0TEGChol |
| hsa-miR-3200-3p MIMAT0015085 | 5'Pm05f005f0f005f05f05f05f05f0f0*0*0*5m0*0*0 | m0m0000m000m0m00m0*0*m0TEGChol |
| hsa-miR-3200-5p MIMAT0017392 | 5'Pm005f005f005f05f0f05f005f05m0*5m0*5m0*0*f0*0*0 | m0m0m00m000m0m00m0*m0*m0TEGChol |
| hsa-miR-3201 MIMAT0015086 | 5'Pm05f05f05f05f0005f05f005f05f00*0*5m0*5m0*f0*5m0*0 | m0m000m0m0m0m0m000*0*m0TEGChol |
| hsa-miR-3202 MIMAT0015089 | 5'Pm00005f05f05f005f05f05f05f00*5m0*0*0*f0*5m0*0 | m0m0000m000m0m0m0*m0*m0TEGChol |
| hsa-miR-320a MIMAT0000510 | 5'Pm0005f0f0005f0f05f000f00*5m0*5m0*5m0*f0*0*0 | m0m0m0m00m00m0m0m0m0*m0*m0TEGChol |
| hsa-miR-320b MIMAT0005792 | 5'Pm0000f005f05f05f05f005f05f00*5m0*5m0*0*f0*5m0*0 | m0m0m00m000m0m0m0*m0*m0TEGChol |
| hsa-miR-320c MIMAT0005793 | 5'Pm005f00f05f000f05f05f00f05m0*0*0*5m0*0*5m0*0*0 | m0m000m0m00m00m0m00*m0*m0TEGChol |
| hsa-miR-320d MIMAT0006764 | 5'Pm05f000f0005f05f005f05f05m0*0*5m0*5m0*f0*5m0*0 | m0m0m00m00m0m0m0m0*0*m0TEGChol |
| hsa-miR-320e MIMAT0015072 | 5'Pm0005f0f05f05f05f0f05f0005f00*5m0*0*5m0*5m0*5m0*0 | m0m0m00m0000m0m0*m0*m0TEGChol |
| hsa-miR-323-3p MIMAT0000755 | 5'Pm05f05f05f05f00005f05f05f05f05m0*5m0*5m0*5m0*5m0*0*0 | m0m0000m0m0m0m000*0*m0TEGChol |
| hsa-miR-323-5p MIMAT0004696 | 5'Pm005f00f05f005f05f005f00f05m0*5m0*5m0*5m0*5m0*0*0 | m0m00m0m00m00m00m0*m0*m0TEGChol |
| hsa-miR-323b-3p MIMAT0015050 | 5'Pm05f0005f05f05f05f05f05f05f0f05m0*5m0*5m0*5m0*5m0*5m0*0 | m0m0000m0000m0m0m0*0*m0TEGChol |
| hsa-miR-323b-5p MIMAT0001630 | 5'Pm005f00f05f000f05f005f0f00*0*5m0*0*f0*0*0 | m0m00m0m0m00m00m00*m0*m0TEGChol |
| hsa-miR-324-3p MIMAT0000762 | 5'Pm0005f0f05f005f005f05f05f0m0*0*0*5m0*5m0*5m0*0 | m0m00m0m0m0m0m0m0m0*m0*m0TEGChol |
| hsa-miR-324-5p MIMAT0000761 | 5'Pm005f005f00005f05f005f00*5m0*0*0*f0*0*0 | m0m000m0m0m0m0m0m0*m0*m0TEGChol |
| hsa-miR-325 MIMAT0000771 | 5'Pm005f005f005f05f05f0005f00*5m0*5m0*5m0*5m0*0 | m0m000m00m00m0m0*m0*m0TEGChol |
| hsa-miR-326 MIMAT0000756 | 5'Pm05f05f05f05f005f05f0f05f005f05m0*5m0*5m0*5m0*5m0*5m0*0 | m0m000m000m0m000*0*m0TEGChol |
| hsa-miR-328 MIMAT0000752 | 5'Pm05f05f005f0005f0f005f05f05f00*5m0*0f0*5m0*0 | m0m000m0m0m0m0m00m0*0*m0TEGChol |
| hsa-miR-329 MIMAT0001629 | 5'Pm00005f0000f05f000f05m0*0*0*f0*0*0 | m0m0m0m00m0m0m0m0m0*m0*m0TEGChol |
| hsa-miR-330-3p MIMAT0000751 | 5'Pm005f00f0000f05f05f05f05m0*5m0*5m0*0*5m0*0*0 | m0m0000m0m0m0m0m00*m0*m0TEGChol |
| hsa-miR-330-5p MIMAT0004693 | 5'Pm00005f05f005f005f05f05f00*5m0*5m0*0*5m0*5m0*0 | m0m0m000m00m0m0m0*m0*m0TEGChol |
| hsa-miR-331-3p MIMAT0000760 | 5'Pm0000f05f005f0f005f05f05f0f00*0*5m0*0*5m0*5m0*0 | m0m00m0m00m0m0m0m0*m0*m0TEGChol |
| hsa-miR-331-5p MIMAT0004700 | 5'Pm05f000f005f005f005f00f05m0*5m0*5m0*0*5m0*0*0 | m0m00m0m00m00m0m0m0*0*m0TEGChol |
| hsa-miR-335 MIMAT0000765 | 5'Pm05f05f05f05f005f00f005f00f05m0*0*0*0*5m0*5m0*0 | m0m0m00m0m0m0m0m000*0*m0TEGChol |

TABLE 5-continued

Examples of chemical modification patterns

| miRNA Name | Example of modified AS strand | Example of modified sense strand |
|---|---|---|
| hsa-miR-335* MIMAT0004703 | 5'Pm0000f005f005f05f05f05f05f05m0*0*5m0*0*5m0*0*0 | m0m0000m0m00m0m0m0m0*m0*m0TEGChol |
| hsa-miR-337-3p MIMAT0000754 | 5'Pm0005f0f005f005f005f00f00*5m0*0*5m0*5m0*0*0 | m0m0m00m0m00m0m00m0*m0*m0TEGChol |
| hsa-miR-337-5p MIMAT0004695 | 5'Pm05f05f00f0005f0f0000f00*0*5m0*0*f0*5m0*0 | m0m0m0m0m00m0m0m0m00*0*m0TEGChol |
| hsa-miR-338-3p MIMAT0000763 | 5'Pm05f05f05f05f00005f05f005f00*5m0*5m0*5m0*5m0*0*0 | m0m0m000m0m0m0m0m000*0*m0TEGChol |
| hsa-miR-338-5p MIMAT0004701 | 5'Pm0000f0005f05f05f05f00*0*5m0*5m0*** | m0m000m0m00m0m0m0m0m0*m0*m0TEGChol |
| hsa-miR-339-3p MIMAT0004702 | 5'Pm005f00f05f005f05f005f00f05m0*5m0*5m0*5m0*5m0*0*0 | m0m00m0m00m00m0m00*m0*m0TEGChol |
| hsa-miR-339-5p MIMAT0000764 | 5'Pm0000f05f05f0f0000f00*0*5m0*0*5m0*0*0 | m0m0m0m0m00m00m0m0m0*m0*m0TEGChol |
| hsa-miR-33a MIMAT0000091 | 5'Pm05f05f005f00005f0000f00*5m0*0*0*f0*0*0 | m0m0m0m0m0m0m0m0m0m00*0*m0TEGChol |
| hsa-miR-33a* MIMAT0004506 | 5'Pm005f05f05f05f05f0f05f0005f05m0*0*5m0*0*5m0*5m0*0 | m0m00m0m00m00m00m000*m0*m0TEGChol |
| hsa-miR-33b MIMAT0003301 | 5'Pm05f0005f005f05f0f005f05f0f05m0*0*5m0*5m0*f0*5m0*0 | m0m000m0m000m0m0m0m0*0*m0TEGChol |
| hsa-miR-33b* MIMAT0004811 | 5'Pm05f05f05f05f05f000f05f05f05f05m0*5m0*5m0*5m0*f0*0*0 | m0m0000m0m00m0m0m000*0*m0TEGChol |
| hsa-miR-340 MIMAT0004692 | 5'Pm05f05f05f05f005f005f05f05f05f00*0*5m0*0*f0*0*0 | m0m000m0m00m0m000*0*m0TEGChol |
| hsa-miR-340* MIMAT0000750 | 5'Pm05f05f05f0f00005f05f005f0f00*0*5m0*f0*0*0 | m0m00m00m0m0m0m0m0m000*0*m0TEGChol |
| hsa-miR-342-3p MIMAT0000753 | 5'Pm05f000f00005f005f00f05m0*0*5m0*5m0*f0*5m0*0 | m0m00m00m0m0m0m0m0m0m0*0*m0TEGChol |
| hsa-miR-342-5p MIMAT0004694 | 5'Pm05f05f05f0f0005f05f005f00*5m0*0*0*f0*5m0*0 | m0m00m00m0m0m0m0m000*0*m0TEGChol |
| hsa-miR-345 MIMAT0000772 | 5'Pm05f000f005f005f05f05f00*5m0*0*5m0*5m0*0*0 | m0m000m0m00m0m0m0m0*0*m0TEGChol |
| hsa-miR-346 MIMAT0000773 | 5'Pm05f0005f005f05f0f05f05f005f00*5m0*5m0*0*5m0*5m0*0 | m0m000m0m000m0m0m0m0*0*m0TEGChol |
| hsa-miR-34a MIMAT0000255 | 5'Pm05f000f05f005f0f005f05f05m0*0*0*0*f0*0*0 | m0m0m0m00m00m0m0m0*0*m0TEGChol |
| hsa-miR-34a* MIMAT0004557 | 5'Pm00005f05f05f005f0000f05m0*0*0*0*f0*5m0*0 | m0m0m0m0m0m0m000m0m0*m0*m0TEGChol |
| hsa-miR-34b MIMAT0004676 | 5'Pm005f005f00005f05f05f005f00*5m0*0*0*f0*0*0 | m0m000m0m00m0m0m0m00*m0*m0TEGChol |
| hsa-miR-34b* MIMAT0000685 | 5'Pm05f000f00005f05f05f005f05m0*5m0*5m0*5m0*f0*** | m0m000m0m0m0m0m0m0*0*m0TEGChol |
| hsa-miR-34c-3p MIMAT0004677 | 5'Pm0000f0000f05f05f005f00*0*0*f0*0*0 | m0m000m0m00m0m0m0m0*m0*m0TEGChol |
| hsa-miR-34c-5p MIMAT0000686 | 5'Pm0000f005f05f005f05f05f05m0*0*5m0*0*5m0*5m0*0 | m0m000m0m000m0m0m0m0*m0*m0TEGChol |
| hsa-miR-3605-3p MIMAT0017982 | 5'Pm05f005f05f05f05f000f05f000f05m0*0*0*5m0*5m0*0*0 | m0m0m00m0m00m00m00m00*0*m0TEGChol |
| hsa-miR-3605-5p MIMAT0017981 | 5'Pm05f05f005f0005f05f0005f05m0*5m0*0*5m0*5m0*0*0 | m0m0m0m0m0m0m0m0m00*0*m0TEGChol |
| hsa-miR-3606 MIMAT0017983 | 5'Pm05f005f0f05f005f0f005f00f00*5m0*5m0*5m0*5m0*5m0*0 | m0m00m00m0m00m00m0m0*0*m0TEGChol |
| hsa-miR-3607-3p MIMAT0017985 | 5'Pm005f05f05f05f005f0f0005f05f05m0*0*5m0*0*5m0*5m0*0 | m0m00m0m00m00m000*m0*m0TEGChol |
| hsa-miR-3607-5p MIMAT0017984 | 5'Pm0000f05f05f0f05f05f005f00*0*0*0*f0*5m0*0 | m0m0m0m00m0m0m0m0*m0*m0TEGChol |
| hsa-miR-3609 MIMAT0017986 | 5'Pm05f000f005f005f00005f00*0*5m0*5m0*5m0*5m0*0 | m0m0m0m0m00m0m00m0m0m0*0*m0TEGChol |
| hsa-miR-3610 MIMAT0017987 | 5'Pm05f000f005f005f0f0005f0f00*5m0*5m0*0*f0*0*0 | m0m0m0m0m00m00m0m0m0*0*m0TEGChol |
| hsa-miR-3611 MIMAT0017988 | 5'Pm0000f005f05f0f05f000f00*0*5m0*0*f0*5m0*0 | m0m000m0m000m0m0m0*m0*m0TEGChol |
| hsa-miR-3612 MIMAT0017989 | 5'Pm05f05f05f05f05f05f05f05f0005f05m0*5m0*5m0**** | m0m0m0m00m0000m000*0*m0TEGChol |
| hsa-miR-3613-3p MIMAT0017991 | 5'Pm005f05f05f05f05f00f00005f00*0*0*5m0*5m0*5m0*0 | m0m0m0m0m0m00m000m000*m0*m0TEGChol |
| hsa-miR-3613-5p MIMAT0017990 | 5'Pm00005f05f05f05f0f05f05f05f05m0*5m0*0*5m0*0*0 | m0m0000m0000m0m0m0*m0*m0TEGChol |
| hsa-miR-361-3p MIMAT0004682 | 5'Pm005f05f05f05f05f0f0005f05f05m0*5m0*0*5m0*5m0*0 | m0m00m0m00m00m00m000*m0*m0TEGChol |
| hsa-miR-3614-3p MIMAT0017993 | 5'Pm0005f0f05f05f005f05f00f05m0*0*0*5m0*f0*0*0 | m0m0m00m00m000m0m0m0*0*m0TEGChol |
| hsa-miR-3614-5p MIMAT0017992 | 5'Pm005f05f05f05f05f00005f00*0*5m0*0*5m0*5m0*0 | m0m00m0m0m0m0m0m0m0*m0*m0TEGChol |
| hsa-miR-3615 MIMAT0017994 | 5'Pm005f05f05f005f00f005f05f05f00*0*5m0*5m0*5m0*0 | m0m000m0m00m00m000*m0*m0TEGChol |

TABLE 5-continued

Examples of chemical modification patterns

| miRNA Name | Example of modified AS strand | Example of modified sense strand |
| --- | --- | --- |
| hsa-miR-361-5p MIMAT0000703 | 5'Pm0005f0f05f05f005f05f05f00f05m0*0*0*5m0*f0*0*0 | m0m0m000m0m00m00m00m0*m0*m0TEGChol |
| hsa-miR-3616-3p MIMAT0017996 | 5'Pm005f00f005f00f05f000f00*0*5m0*5m0*5m0*0*0 | m0m0m0m00m0m00m0m0m0**m0*m0TEGChol |
| hsa-miR-3616-5p MIMAT0017995 | 5'Pm05f05f05f05f005f005f0005f00*5m0*5m0*0*5m0*0*0 | m0m00m00m00m0m0m0m000*0*m0TEGChol |
| hsa-miR-3617 MIMAT0017997 | 5'Pm0005f0f0005f0f05f05f0005f00*5m0*0*5m0*5m0*5m0*0 | m0m00m0m00m0m00m0m00m0*m0*m0TEGChol |
| hsa-miR-3618 MIMAT0017998 | 5'Pm005f05f05f0005f0f05f05f05f0f05m0*5m0*0*5m0*f0*5m0*0 | m0m0000m000m0m0m000*m0*m0TEGChol |
| hsa-miR-3619 MIMAT0017999 | 5'Pm05f05f05f0f00005f05f005f0f05m0*0*5m0*5m0*5m0*5m0*0 | m0m00m0m00m0m0m0m000*0*m0TEGChol |
| hsa-miR-3620 MIMAT0018001 | 5'Pm05f0005f05f05f005f05f05m0*5m0*0*5m0*5m0*5m0*0 | m0m000m0m0m0m0m00m0*0*m0TEGChol |
| hsa-miR-3621 MIMAT0018002 | 5'Pm05f0005f00005f005f05f05f00*5m0*5m0*0*5m0*0*0 | m0m000m0m0m0m0m0m0m0*0*m0TEGChol |
| hsa-miR-3622a-3p MIMAT0018004 | 5'Pm05f05f05f05f05f05f05f05f05f0f05m0*5m0*5m0*5m0*5m0*5m0*0 | m0m0000m0000m000*0*m0TEGChol |
| hsa-miR-3622a-5p MIMAT0018003 | 5'Pm0005f0f005f05f0f05f05f05f05m0*0*0*0*f0*5m0* | m0m0000m000m0m00m0*m0*m0TEGChol |
| hsa-miR-3622b-3p MIMAT0018006 | 5'Pm05f05f00f00005f0000f05m0*5m0*5m0*5m0*f0*5m0*0 | m0m0m0m0m0m0m0m0m0m0m00*0*m0TEGChol |
| hsa-miR-3622b-5p MIMAT0018005 | 5'Pm05f0005f05f005f0f05f05f05f0f05m0*5m0*5m0*5m0*5m0*5m0*0 | m0m0000m00m0m0m0m0*0*m0TEGChol |
| hsa-miR-362-3p MIMAT0004683 | 5'Pm0000f05f005f05f05f005f0f00*5m0*0*5m0*f0*0*0 | m0m00m00m00m0m0m0m0*m0*m0TEGChol |
| hsa-miR-362-5p MIMAT0000705 | 5'Pm005f05f05f05f005f05f00005f00*0*5m0*0*5m0*5m0*0 | m0m0m00m00m0m00m00m000*m0*m0TEGChol |
| hsa-miR-363 MIMAT0000707 | 5'Pm05f000f0005f0f005f00f05m0*0*0*0*f0*0*0 | m0m00m00m0m0m0m0m0*0*m0TEGChol |
| hsa-miR-363* MIMAT0003385 | 5'Pm05f0005f00005f005f05f05f00*5m0*5m0*0*f0*0*0 | m0m00m0m0m0m0m0m0m0*0*m0TEGChol |
| hsa-miR-3646 MIMAT0018065 | 5'Pm0005f05f05f05f00f005f05f05f00*5m0*0*0*f0*0*0 | m0m000m0m000m0m0m0*m0*m0TEGChol |
| hsa-miR-3647-3p MIMAT0018067 | 5'Pm05f05f005f05f0005f05f000f00*0*5m0*0*f0*0*0 | m0m00m00m0m0m00m00*0*m0TEGChol |
| hsa-miR-3647-5p MIMAT0018066 | 5'Pm0000f05f05f00f05f0005f05m0*0*5m0*5m0*5m0*0 | m0m0m00m00m000m0m0m0*m0*m0TEGChol |
| hsa-miR-3648 MIMAT0018068 | 5'Pm00005f005f05f0f05f005f00f00*5m0*5m0*0*f0*5m0*0 | m0m0m00m000m0m0m0*m0*m0TEGChol |
| hsa-miR-3649 MIMAT0018069 | 5'Pm0005f0f005f005f005f05f05m0*0*0*5m0*5m0*5m0*0 | m0m000m00m00m00m0m0*m0*m0TEGChol |
| hsa-miR-365 MIMAT0000710 | 5'Pm05f05f05f05f05f005f05f005f05f0f05m0*5m0*5m0*5m0*5m0*0*0 | m0m0m0m00m00m000*0*m0TEGChol |
| hsa-miR-365* MIMAT0009199 | 5'Pm0005f0f05f0005f05f05f05f0f00*0*5m0*0*f0*0*0 | m0m0000m0m0m00m00*m0*m0TEGChol |
| hsa-miR-3650 MIMAT0018070 | 5'Pm05f05f05f05f005f005f0005f05m0*5m0*5m0*5m0*5m0*5m0*0 | m0m00m00m00m0m0m000*0*m0TEGChol |
| hsa-miR-3651 MIMAT0018071 | 5'Pm0000f0005f0f0005f0f05m0*5m0*0*0*f0*0*0 | m0m00m0m00m0m0m0m0m0*m0*m0TEGChol |
| hsa-miR-3652 MIMAT0018072 | 5'Pm05f0005f05f005f05f005f00f00*5m0*5m0*0*f0*0*0 | m0m0m00m0m0m0m00m0m0*0*m0TEGChol |
| hsa-miR-3653 MIMAT0018073 | 5'Pm0000f05f0005f05f05f0f00*0*5m0*5m0*5m0*5m0*0 | m0m00m00m0m0m0m0m0m0*m0*m0TEGChol |
| hsa-miR-3654 MIMAT0018074 | 5'Pm00005f05f05f0f05f005f05f00*0*5m0*5m0*5m0*0 | m0m00m00m0m0m00m0m0*m0*m0TEGChol |
| hsa-miR-3655 MIMAT0018075 | 5'Pm05f05f00f0005f05f005f00f05m0*0*0*0*f0*5m0*0 | m0m00m00m0m00m00m0*0*m0TEGChol |
| hsa-miR-3656 MIMAT0018076 | 5'Pm0005f0f05f005f0f00005f00*5m0*5m0*0*f0*5m0* | m0m0m0m00m0m0m0m0*m0*m0TEGChol |
| hsa-miR-3657 MIMAT0018077 | 5'Pm05f05f05f05f0005f05f05f05f00f05m0*0*0*0*f0*0*0 | m0m000m00m0m0m000*0*m0TEGChol |
| hsa-miR-3658 MIMAT0018078 | 5'Pm0000f05f05f005f05f05f00*5m0*5m0*5m0*5m0*5m0*0 | m0m00m00m00m0m0m0m0*m0*m0TEGChol |
| hsa-miR-3659 MIMAT0018080 | 5'Pm05f05f00f0005f05f05f005f0f00*0*0*5m5m0*f0*0*0 | m0m00m00m0m0m0m00*0*m0TEGChol |
| hsa-miR-3660 MIMAT0018081 | 5'Pm0000f005f05f0f05f005f05m0*0*5m0*5m0*5m0*0 | m0m000m000m0m0m0m0*m0*m0TEGChol |
| hsa-miR-3661 MIMAT0018082 | 5'Pm005f00f05f005f0f05f0005f05m0*0*0*5m0*5m0*5m0*0 | m0m00m00m00m00m0m0*m0*m0TEGChol |
| hsa-miR-3662 MIMAT0018083 | 5'Pm05f0005f0000f05f000f00*5m0*5m0*0*f0*5m0*0 | m0m0m0m0m0m0m0m0m0m0*0*m0TEGChol |

TABLE 5-continued

Examples of chemical modification patterns

| miRNA Name | Example of modified AS strand | Example of modified sense strand |
|---|---|---|
| hsa-miR-3663-3p MIMAT0018085 | 5'Pm0005f05f05f00f0000f00*0*0*f0** | m0m0m0m0m0m0m000m00m0*m0*m0TEGChol |
| hsa-miR-3663-5p MIMAT0018084 | 5'Pm0005f0f05f05f005f05f000f05m0*0*0*5m0*f0*0*0 | m0m0m0m00m0m000m00m0*m0*m0TEGChol |
| hsa-miR-3664 MIMAT0018086 | 5'Pm00005f0005f0f0005f05f00*0*5m0*0*f0*5m0*0 | m0m0m0m0m0m0m0m0m0*m0*m0TEGChol |
| hsa-miR-3665 MIMAT0018087 | 5'Pm05f000f005f00f005f05f05m0*0*0*5m0*5m0*5m0*0 | m0m00m00m0m00m0m0m0m0*0*m0TEGChol |
| hsa-miR-3666 MIMAT0018088 | 5'Pm0000f005f05f05f05f0005f05m0*0*5m0*5m0*5m0*5m0*0 | m0m00m00m0m00m0m0m0*m0*m0TEGChol |
| hsa-miR-3667-3p MIMAT0018090 | 5'Pm0000f05f0005f00005f05m0*0*5m0*0*5m0*0*0 | m0m0m0m0m0m0m00m0m0*m0*m0TEGChol |
| hsa-miR-3667-5p MIMAT0018089 | 5'Pm0000f05f05f05f0f05f005f05m0*0*0*0*f0** | m0m00m00m0000m0m0*m0*m0TEGChol |
| hsa-miR-3668 MIMAT0018091 | 5'Pm0000f05f0005f05f005f0f00*5m0*5m0*5m0*5m0*5m0*0*0 | m0m00m00m0m00m0m0m0*m0*m0TEGChol |
| hsa-miR-3669 MIMAT0018092 | 5'Pm05f05f05f0f0005f05f0000f00*0*5m0*0*5m0*5m0*0 | m0m0m0m0m0m00m0m0m000*0*m0TEGChol |
| hsa-miR-367 MIMAT0000719 | 5'Pm05f05f005f0005f0f0000f05m0*0*5m0*5m0*5m0*0 | m0m0m0m0m0m0m0m0m00*0*m0TEGChol |
| hsa-miR-367* MIMAT0004686 | 5'Pm005f05f05f00f05f005f05f00*5m0*5m0*0*f0*5m0*0 | m0m0m0m0m0m000m0m00*m0*m0TEGChol |
| hsa-miR-3670 MIMAT0018093 | 5'Pm0005f05f0005f05f005f005f05m0*0*5m0*0*5m0*5m0*0 | m0m00m00m0m00m0m00m0*m0*m0TEGChol |
| hsa-miR-3671 MIMAT0018094 | 5'Pm0000f005f05f05f0005f05m0*0*5m0*5m0*5m0*5m0*0 | m0m0m0m0m0m000m0m0*m0*m0TEGChol |
| hsa-miR-3672 MIMAT0018095 | 5'Pm05f05f05f0f05f05f00f0005f0f00*0*5m0*5m0*5m0*0 | m0m0m0m0m0m000m000*0*m0TEGChol |
| hsa-miR-3673 MIMAT0018096 | 5'Pm05f0005f05f05f005f005f00f00*5m0*5m0*5m0*f0*5m0*0 | m0m0m0m00m0m00m0m00*m0*m0TEGChol |
| hsa-miR-3674 MIMAT0018097 | 5'Pm0005f0f005f05f05f05f005f0f05m0*0*0*0*f0*0*0 | m0m00m00m000m0m00*m0*m0TEGChol |
| hsa-miR-3675-3p MIMAT0018099 | 5'Pm005f005f05f005f05f05f00f00*0*0*5m0*f0*0*0 | m0m000m0m0m0m0m0*m0*m0TEGChol |
| hsa-miR-3675-5p MIMAT0018098 | 5'Pm05f05f00f05f000f05f000f00*0*0*5m0*5m0*5m0*0 | m0m00m00m0m00m0m00*0*m0TEGChol |
| hsa-miR-3676 MIMAT0018100 | 5'Pm0000f05f0f05f05f0005f05m0*5m0*0*5m0*5m0*5m0*0 | m0m00m00m00m0m0m0*m0*m0TEGChol |
| hsa-miR-3677 MIMAT0018101 | 5'Pm005f05f05f05f005f05f05f0005f00*0*5m0*0*5m0*5m0*0 | m0m00m00m00m0m000*m0*m0TEGChol |
| hsa-miR-3678-3p MIMAT0018103 | 5'Pm0005f0f05f05f005f05f005f05m0*5m0*5m0*5m0*f0*0*0 | m0m00m00m0m000m0m0*m0*m0TEGChol |
| hsa-miR-3678-5p MIMAT0018102 | 5'Pm0000f05f005f0f00005f00*5m0*0*0*f0*0*0 | m0m0m0m0m00m0m0m0m0*m0*m0TEGChol |
| hsa-miR-3679-3p MIMAT0018105 | 5'Pm05f05f05f05f05f005f05f05f05f0f05m0*5m0*5m0*5m0*5m0*5m0*0 | m0m0000m0m000m000*0*m0TEGChol |
| hsa-miR-3679-5p MIMAT0018104 | 5'Pm0005f05f05f005f0f05f05f005f05m0*5m0*0*0*f0*0*0 | m0m000m00m00m0m00*m0*m0TEGChol |
| hsa-miR-3680 MIMAT0018106 | 5'Pm05f05f05f05f005f005f005f00*5m0*5m0*5m0*5m0*5m0*0 | m0m00m00m0m00m0m000*0*m0TEGChol |
| hsa-miR-3680* MIMAT0018107 | 5'Pm05f005f05f0005f05f05f00f05m0*0*0*5m0*f0** | m0m000m0m0m0m0m0*0*m0TEGChol |
| hsa-miR-3681 MIMAT0018108 | 5'Pm0005f05f05f05f005f005f00*0*5m0*5m0*0*0 | m0m00m00m00m000m00m0*m0*m0TEGChol |
| hsa-miR-3681* MIMAT0018109 | 5'Pm05f05f005f05f0005f05f05f05f00*0*5m0*5m0*f0*5m0*0 | m0m0m0m0m0m0m0m00*0*m0TEGChol |
| hsa-miR-3682 MIMAT0018110 | 5'Pm0005f05f05f05f05f005f0f00*0*0*5m0*0*0 | m0m00m00m0m00m0m0*m0*m0TEGChol |
| hsa-miR-3683 MIMAT0018111 | 5'Pm0000f05f0005f05f005f0f00*5m0*5m0*5m0*5m0*5m0*0 | m0m0m0m0m0m00m0m0*m0*m0TEGChol |
| hsa-miR-3684 MIMAT0018112 | 5'Pm0000f05f0005f0005f0f05m0*5m0*5m0*5m0*5m0*5m0*0 | m0m0m0m0m0m00m0m0*m0*m0TEGChol |
| hsa-miR-3685 MIMAT0018113 | 5'Pm00005f05f05f005f005f05f05f00*5m0*0*f0*5m0*0 | m0m000m0m0m0m0m0m0m0*0*m0TEGChol |
| hsa-miR-3686 MIMAT0018114 | 5'Pm0000f005f05f0f05f0005f05m0*5m0*5m0*5m0*5m0*0 | m0m00m00m0m00m0m0*m0*m0TEGChol |
| hsa-miR-3687 MIMAT0018115 | 5'Pm0000f05f05f05f0f005f00f00*5m0*5m0*5m0*** | m0m0m0m0m0m0000m0m0*m0*m0TEGChol |
| hsa-miR-3688 MIMAT0018116 | 5'Pm0000f05f0005f05f005f0f00*5m0*5m0*5m0*5m0*5m0*0 | m0m00m00m0m00m0m0*m0*m0TEGChol |
| hsa-miR-3689a-3p MIMAT0018118 | 5'Pm0005f05f00f005f05f05m0*5m0*0*5m0*5m0*0*0 | m0m000m0m00m00m0*m0*m0TEGChol |
| hsa-miR-3689a-5p MIMAT0018117 | 5'Pm05f05f05f0f0005f05f005f00f00*0*0*5m0*f0*5m0*0 | m0m0m0m00m0m00m0m000*0*m0TEGChol |

TABLE 5-continued

Examples of chemical modification patterns

| miRNA Name | Example of modified AS strand | Example of modified sense strand |
| --- | --- | --- |
| hsa-miR-3689b MIMAT0018180 | 5'Pm00005f005f05f0f05f0005f00*5m0*5m0*5m0*f0*0*0 | m0m0m0m00m000m0m0m0m0*m0*m0TEGChol |
| hsa-miR-3689b* MIMAT0018181 | 5'Pm05f005f0f05f05f00f05f005f0f05m0*0*0*5m0*f0*0*0 | m0m00m0m0m00m00m0*0*m0TEGChol |
| hsa-miR-3690 MIMAT0018119 | 5'Pm05f0005f0005f0f05f000f00*0*5m0*5m0*f0*0*0 | m0m00m00m00m0m0m0m0m0*0*m0TEGChol |
| hsa-miR-3691 MIMAT0018120 | 5'Pm0000f005f00f05f005f05f05m0*5m0*5m0*0*f0*0*0 | m0m00m00m0m0m0m0m0m0*m0*m0TEGChol |
| hsa-miR-3692 MIMAT0018122 | 5'Pm05f05f005f05f0005f05f005f05f00*0*5m0*5m0*f0*5m0*0 | m0m0m0m0m0m0m00*0*m0TEGChol |
| hsa-miR-3692* MIMAT0018121 | 5'Pm05f05f00f05f005f05f0005f0f00*5m0*5m0*5m0*5m0*0*0 | m0m0m0m00m00m00m00*0*m0TEGChol |
| hsa-miR-369-3p MIMAT0000721 | 5'Pm0005f05f05f005f05f05f05f05f05m0*5m0*5m0*0*5m0** | m0m0m000m00m00m0m0m0*m0*m0TEGChol |
| hsa-miR-369-5p MIMAT0001621 | 5'Pm005f00f05f005f05f05f05f00f05m0*0*5m0*5m0*f0*0*0 | m0m0m000m00m00m0m00*m0*m0TEGChol |
| hsa-miR-370 MIMAT0000722 | 5'Pm00005f005f05f05f05f0005f00*0*5m0*0*f0*0*0 | m0m0m0m0m00m0m0m0m0*m0*m0TEGChol |
| hsa-miR-3713 MIMAT0018164 | 5'Pm05f000f005f005f05f005f00f00*0*5m0*5m0*f0*5m0*0 | m0m0m000m00m00m0m0m0*0*m0TEGChol |
| hsa-miR-371-3p MIMAT0000723 | 5'Pm05f05f05f05f05f05f05f0f05f05f005f05m0*5m0*5m0*0*5m0*0*0 | m0m0m0000m0000m000*0*m0TEGChol |
| hsa-miR-3714 MIMAT0018165 | 5'Pm005f05f05f05f005f05f000f00*5m0*5m0*5m0*5m0*5m0* | m0m0m00m0m0m000m000*m0*m0TEGChol |
| hsa-miR-371-5p MIMAT0004687 | 5'Pm05f05f05f05f005f05f05f05f05f05f0f00*0*0*0*5m0*5m0*0 | m0m0000m000m0m000*0*m0TEGChol |
| hsa-miR-372 MIMAT0000724 | 5'Pm05f000f005f05f05f005f00f05m0*0*5m0*f0*5m0*0 | m0m00m0m0m000m0m0m0*0*m0TEGChol |
| hsa-miR-373 MIMAT0000726 | 5'Pm05f005f0f05f05f005f05f00*5m0*0*5m0*5m0*0*0 | m0m00m0m00m000m00m0*0*m0TEGChol |
| hsa-miR-373* MIMAT0000725 | 5'Pm0000f05f05f00f0005f05f00*5m0*5m0*5m0*5m0*5m0*0 | m0m0m0m0m000m0m0m0*m0*m0TEGChol |
| hsa-miR-374a MIMAT0000727 | 5'Pm0005f0f05f05f05f005f05f0f00*5m0*0*5m0*f0*5m0*0 | m0m00m00m0000m00m0*m0*m0TEGChol |
| hsa-miR-374a* MIMAT0004688 | 5'Pm05f05f005f005f05f0f0000f05m0*5m0*0*0*f0*5m0*0 | m0m0m0m0m000m00m00*0*m0TEGChol |
| hsa-miR-374b MIMAT0004955 | 5'Pm05f005f0f05f005f05f05f05f00*5m0*0*5m0*5m0*0*0 | m0m0m0m00m000m0m0*0*m0TEGChol |
| hsa-miR-374b* MIMAT0004956 | 5'Pm00005f005f05f05f0005f05m0*5m0*5m0*0*f0*0*0 | m0m0m0m00m000m0m0m0*m0*m0TEGChol |
| hsa-miR-374c MIMAT0018443 | 5'Pm005f05f05f0005f05f05f05f0f00*5m0*0*5m0*f0*0*0 | m0m0000m00m0m000*m0*m0TEGChol |
| hsa-miR-375 MIMAT0000728 | 5'Pm05f05f005f05f000f005f005f00*0*5m0*5m0*5m0*5m0*0 | m0m00m0m0m0m00m00*0*m0TEGChol |
| hsa-miR-376a MIMAT0000729 | 5'Pm05f05f00f0005f0f0005f05f05m0*0*0*5m0*5m0*5m0*0 | m0m0m00m00m0m0m0m00*0*m0TEGChol |
| hsa-miR-376a* MIMAT0003386 | 5'Pm05f05f05f05f05f05f005f05f005f05m0*5m0*0*5m0*5m0*5m0*0 | m0m000m0m000m000*0*m0TEGChol |
| hsa-miR-376b MIMAT0002172 | 5'Pm005f00f05f005f05f005f05f0f00*0*5m0*5m0*0*0 | m0m000m0m00m00m0m0*m0*m0TEGChol |
| hsa-miR-376c MIMAT0000720 | 5'Pm00005f05f000f005f05f0f00*0*0*5m0*5m0*0*0 | m0m0m0m0m0m0m0m0*m0*m0TEGChol |
| hsa-miR-377 MIMAT0000730 | 5'Pm0005f05f05f05f05f05f0f05f05f005f05m0*5m0*0*0*f0*5m0*0 | m0m0m000m0000m00m0*m0*m0TEGChol |
| hsa-miR-377* MIMAT0004689 | 5'Pm05f000f0005f05f0005f0f00*0*0*0*f0*0*0 | m0m0m0m0m0m0m0m0m0*0*m0TEGChol |
| hsa-miR-378 MIMAT0000732 | 5'Pm05f05f05f0f00005f0000f00*5m0*0*5m0*5m0*5m0*0 | m0m0m0m0m0m0m0m000*0*m0TEGChol |
| hsa-miR-378* MIMAT0000731 | 5'Pm05f05f0f005f005f0005f05f05m0*0*0*5m0*5m0*0 | m0m00m00m00m00m000*0*m0TEGChol |
| hsa-miR-378b MIMAT0014999 | 5'Pm05f0005f00005f05f05f00f05m0*5m0*5m0*0*0*5m0** | m0m000m00m0m0m0m0m0*0*m0TEGChol |
| hsa-miR-378c MIMAT0016847 | 5'Pm05f005f0f005f005f0005f05f05m0*0*0*5m0*f0*0*0 | m0m00m0m00m00m0m0m0*0*m0TEGChol |
| hsa-miR-379 MIMAT0000733 | 5'Pm0000f05f05f005f05f05f00*5m0*5m0*5m0*5m0*5m0* | m0m0m000m00m00m0m0m0*m0*m0TEGChol |
| hsa-miR-379* MIMAT0004690 | 5'Pm05f05f05f05f005f05f05f05f05f00f05m0*0*5m0*5m0*** | m0m0m000m0m000*0*m0TEGChol |
| hsa-miR-380 MIMAT0000735 | 5'Pm05f05f05f05f05f05f05f0f0000f05m0*0*5m0*5m0*5m0*5m0* | m0m0m0m0m0000m000*0*m0TEGChol |
| hsa-miR-380* MIMAT0000734 | 5'Pm05f005f05f05f005f05f00005f05m0*5m0*5m0*5m0*** | m0m0m0m0m0m0m0m0*0*m0TEGChol |
| hsa-miR-381 MIMAT0000736 | 5'Pm05f005f05f0000f05f0005f05m0*5m0*5m0*5m0*f0*5m0*0 | m0m0m00m0m0m0m0m0m0*0*m0TEGChol |
| hsa-miR-382 MIMAT0000737 | 5'Pm0005f0f05f05f05f05f0005f0f00*5m0*0*5m0*f0*0*0 | m0m0m0m0m0000m0m0*m0*m0TEGChol |

TABLE 5-continued

Examples of chemical modification patterns

| miRNA Name | Example of modified AS strand | Example of modified sense strand |
|---|---|---|
| hsa-miR-383 MIMAT0000738 | 5'Pm005f005f05f05f005f05f0005f05m0*0*5m0*5m0*f0*5m0*0 | m0m0m0m00m0m000m0m00*m0*m0TEGChol |
| hsa-miR-384 MIMAT0001075 | 5'Pm00005f0000f0000f00*0*5m0*5m0*5m0*0*0 | m0m0m0m0m0m0m0m0m0m0m0*m0*m0TEGChol |
| hsa-miR-3907 MIMAT0018179 | 5'Pm05f005f0f00005f005f0f00*0*0*5m0*5m0*0*0 | m0m00m0m0m0m0m00m00*0*m0TEGChol |
| hsa-miR-3908 MIMAT0018182 | 5'Pm0005f0f05f05f00f05f05f00f00*5m0*0*5m0*5m0*0*0 | m0m000m0m00m0m0m0m0*m0*m0TEGChol |
| hsa-miR-3909 MIMAT0018183 | 5'Pm05f05f05f05f05f005f05f05f005f05m0*0*0*0*f0*5m0*0 | m0m00m000m00m00m000*0*m0TEGChol |
| hsa-miR-3910 MIMAT0018184 | 5'Pm0005f0f0005f05f005f0f00*0*5m0*5m0*0*0 | m0m00m0m00m0m0m00m00*m0*m0TEGChol |
| hsa-miR-3911 MIMAT0018185 | 5'Pm05f05f005f05f05f05f0f005f05f05m0*5m0*5m0*5m0*f0*5m0*0 | m0m000m0m0000m0m00*0*m0TEGChol |
| hsa-miR-3912 MIMAT0018186 | 5'Pm05f005f0f05f05f05f0f0005f0f00*0*0*0*5m0*5m0*0 | m0m0m0m0m0000m00m0*0*m0TEGChol |
| hsa-miR-3913 MIMAT0018187 | 5'Pm05f05f0f05f0f005f0f0000f05m0*5m0*0*5m0*f0*5m0*0 | m0m00m0m0m0m00m0m000*0*m0TEGChol |
| hsa-miR-3914 MIMAT0018188 | 5'Pm05f0005f0000f0005f0f00*0*0*5m0*5m0*0*0 | m0m00m0m0m0m0m0m0m0m0*0*m0TEGChol |
| hsa-miR-3915 MIMAT0018189 | 5'Pm0000f0005f05f0000f05m0*5m0*5m0*5m0*f0*0*0 | m0m0m0m0m00m0m0m0m0m0*m0*m0TEGChol |
| hsa-miR-3916 MIMAT0018190 | 5'Pm0000f05f0005f00005f05m0*0*5m0*0*5m0*5m0*0 | m0m0m0m0m0m00m0m0m0m0*m0*m0TEGChol |
| hsa-miR-3917 MIMAT0018191 | 5'Pm05f05f005f05f00f05f05f05f00*5m0*5m0*0*5m0*0*0 | m0m0m000m0m0m00m00*0*m0TEGChol |
| hsa-miR-3918 MIMAT0018192 | 5'Pm005f05f05f05f005f05f005f05f05m0*0*0*0*5m0** | m0m00m00m0m000m000*m0*m0TEGChol |
| hsa-miR-3919 MIMAT0018193 | 5'Pm05f0005f0000f0005f0f00*0*0*5m0*5m0*0*0 | m0m00m0m0m0m0m0m0m0m0*0*m0TEGChol |
| hsa-miR-3920 MIMAT0018195 | 5'Pm0005f0f05f0005f005f05f0f00*0*0*0*f0*0*0 | m0m0m0m0m0m00m00m0*m0*m0TEGChol |
| hsa-miR-3921 MIMAT0018196 | 5'Pm005f005f05f05f005f05f05f00*5m0*5m0*0*f0*5m0*0 | m0m00m00m0m000m0m0*m0*m0TEGChol |
| hsa-miR-3922 MIMAT0018197 | 5'Pm05f05f005f005f05f0f05f005f05f00*5m0*5m0*0*5m0*5m0*0 | m0m00m000m0m0m00*0*m0TEGChol |
| hsa-miR-3923 MIMAT0018198 | 5'Pm05f05f0f005f005f0005f05f05m0*0*5m0*5m0*f0*0*0 | m0m00m0m0m0m00m0m0m0*0*m0TEGChol |
| hsa-miR-3924 MIMAT0018199 | 5'Pm0000f05f005f05f005f05f05f00*5m0*0*0*5m0*5m0*0 | m0m0m0m00m00m0m00m0*m0*m0TEGChol |
| hsa-miR-3925 MIMAT0018200 | 5'Pm00005f05f05f05f05f05f0005f00*5m0*5m0*5m0*5m0*0*0 | m0m0m00m0000m0m0*m0*m0TEGChol |
| hsa-miR-3926 MIMAT0018201 | 5'Pm05f0005f005f005f0005f05f00*0*5m0*5m0*5m0*0 | m0m0m0m0m00m0m0m0m0*0*m0TEGChol |
| hsa-miR-3927 MIMAT0018202 | 5'Pm005f005f005f05f05f00005f00*0*0*0*f0*5m0*0 | m0m0m0m0m0m000m0m00*m0*m0TEGChol |
| hsa-miR-3928 MIMAT0018205 | 5'Pm00005f05f005f0f005f05f0f05m0*5m0*5m0*5m0*5m0*0*0 | m0m0m0m00m00m0m0m0m0*m0*m0TEGChol |
| hsa-miR-3929 MIMAT0018206 | 5'Pm0000f05f0005f05f005f0f00*5m0*5m0*5m0*5m0*5m0*0 | m0m00m0m00m0m0m0m0*m0*m0TEGChol |
| hsa-miR-3934 MIMAT0018349 | 5'Pm00005f005f005f05f005f0f00*5m0*0*5m0*f0*5m0*0 | m0m0m0m00m0m0m0m0m0*m0*m0TEGChol |
| hsa-miR-3935 MIMAT0018350 | 5'Pm0005f05f05f005f05f05f0005f05m0*5m0*5m0*5m0*5m0*0*0 | m0m0m00m00m00m0m0*m0*m0TEGChol |
| hsa-miR-3936 MIMAT0018351 | 5'Pm005f05f05f005f0f05f0005f05m0*0*5m0*5m0*5m0*0 | m0m0m00m0m0m0m0m00*m0*m0TEGChol |
| hsa-miR-3937 MIMAT0018352 | 5'Pm05f005f05f005f005f0000f05m0*5m0*0*5m0*5m0*0* | m0m0m0m00m0m0m00m0*0*m0TEGChol |
| hsa-miR-3938 MIMAT0018353 | 5'Pm0005f0f05f0005f005f0f00*0*0*f0*0*0 | m0m0m0m0m00m0m0m0*m0*m0TEGChol |
| hsa-miR-3939 MIMAT0018355 | 5'Pm05f05f00f05f000f05f05f00*5m0*5m0*0*5m0*5m0*0 | m0m000m0m00m0m0m00*0*m0TEGChol |
| hsa-miR-3940 MIMAT0018356 | 5'Pm0000f0005f05f05f05f0f00*0*5m0*5m0*5m0*0 | m0m0000m0m0m0m0m0*m0*m0TEGChol |
| hsa-miR-3941 MIMAT0018357 | 5'Pm05f05f00f05f05f05f05f0005f05m0*5m0*0*0*f0*0*0 | m0m0m0m00m0000m0m00*0*m0TEGChol |
| hsa-miR-3942 MIMAT0018358 | 5'Pm05f0005f005f00f05f05f05f0f05m0*5m0*0*0*f0*5m0*0 | m0m0000m0m0m0m0m0*0*m0TEGChol |
| hsa-miR-3943 MIMAT0018359 | 5'Pm005f05f05f05f0005f0000f05m0*0*0*0*f0*5m0*0 | m0m00m0m0m0m0m00m000*m0*m0TEGChol |
| hsa-miR-3944 MIMAT0018360 | 5'Pm0005f0f0005f0f0000f00*5m0*5m0*5m0*0*5m0*0 | m0m0m0m0m0m0m0m00m0*m0*m0TEGChol |
| hsa-miR-3945 MIMAT0018361 | 5'Pm005f05f0f05f005f05f05f005f05m0*5m0*0*0*5m0*5m0*0 | m0m00m00m00m00m000*m0*m0TEGChol |
| hsa-miR-409-3p MIMAT0001639 | 5'Pm005f05f05f00005f05f000f00*5m0*5m0*0*5m0*0*0 | m0m0m0m0m0m00m0m000*m0*m0TEGChol |

TABLE 5-continued

Examples of chemical modification patterns

| miRNA Name | Example of modified AS strand | Example of modified sense strand |
|---|---|---|
| hsa-miR-409-5p MIMAT0001638 | 5'Pm05f05f005f05f05f005f05f05f00f05m0*5m0*5m0*0*5m0*0*0 | m0m0m000m0m00m0m00*0*m0TEGChol |
| hsa-miR-410 MIMAT0002171 | 5'Pm005f05f05f05f05f05f0f05f05f05f05m0*0*0*0*5m0*0*0 | m0m0000m0000m000*m0*m0TEGChol |
| hsa-miR-411 MIMAT0003329 | 5'Pm005f005f005f05f05f00005f00*0*0*0*f0*5m0*0 | m0m0m0m0m000m0m0m00*m0*m0TEGChol |
| hsa-miR-411* MIMAT0004813 | 5'Pm0005f0f05f05f005f05f05f00f05m0*0*0*0*f0*5m0*0 | m0m0m000m0m00m0m00*m0*m0TEGChol |
| hsa-miR-412 MIMAT0002170 | 5'Pm0000f05f005f0f05f0005f00*0*0*5m0*f0*5m0*0 | m0m0m00m0m00m0m0m0*m0*m0TEGChol |
| hsa-miR-421 MIMAT0003339 | 5'Pm05f05f005f0000f0000f00*5m0*5m0*5m0*f0*5m0*0 | m0m0m0m0m0m0m0m0m0m00*0*m0TEGChol |
| hsa-miR-422a MIMAT0001339 | 5'Pm05f000f05f05f05f05f05f05f05f05m0*5m0*0*5m0*f0*0*0 | m0m0000m0000m0m0m0*0*m0TEGChol |
| hsa-miR-423-3p MIMAT0001340 | 5'Pm005f05f05f005f05f005f005f00*5m0*5m0*5m0*f0*5m0*0 | m0m0m00m0m000m0m00*m0*m0TEGChol |
| hsa-miR-423-5p MIMAT0004748 | 5'Pm0005f05f005f05f0f05f05f05f0f05m0*5m0*0*0*f0*5m0*0 | m0m0m00m00m0m0m0m0m0*m0*m0TEGChol |
| hsa-miR-424 MIMAT0001341 | 5'Pm05f05f005f0000f0000f00*5m0*5m0*5m0*f0*5m0*0 | m0m0m0m0m0m0m0m0m0m00*0*m0TEGChol |
| hsa-miR-424* MIMAT0004749 | 5'Pm05f000f05f005f05f05f05f05f05m0*5m0*5m0*5m0*5m0*0 | m0m00m00m0m0m0m0m0m0*0*m0TEGChol |
| hsa-miR-425 MIMAT0003393 | 5'Pm005f005f0000f0000f05m0*5m0*5m0*5m0*f0*5m0*0 | m0m0m0m0m0m0m0m0m0m00*m0*m0TEGChol |
| hsa-miR-425* MIMAT0001343 | 5'Pm05f05f005f05f00f00005f00*0*5m0*5m0*5m0*5m0*0 | m0m0m0m0m0m00m0m00*0*m0TEGChol |
| hsa-miR-4251 MIMAT0016883 | 5'Pm0000f0000f0000f00*0*0*5m0*f0*0*0 | m0m0m0m0m0m0m0m0m0m0*m0*m0TEGChol |
| hsa-miR-4252 MIMAT0016886 | 5'Pm0005f0f005f005f05f05f0f05f00*5m0*5m0*0*f0*5m0*0 | m0m0000m0m00m0m0m0*m0*m0TEGChol |
| hsa-miR-4253 MIMAT0016882 | 5'Pm005f05f05f05f05f05f05f05f05f05f05m0*5m0*5m0*5m0*5m0*5m0* | m0m0000m0000m000*m0*m0TEGChol |
| hsa-miR-4254 MIMAT0016884 | 5'Pm005f05f05f05f0005f0005f0f00*5m0*0*5m0*0*0 | m0m00m0m0m0m0m0m000*m0*m0TEGChol |
| hsa-miR-4255 MIMAT0016885 | 5'Pm05f05f05f05f05f005f05f005f05f05f00*0*0*5m0*f0*5m0*0 | m0m0m00m00m000*0*m0TEGChol |
| hsa-miR-4256 MIMAT0016877 | 5'Pm05f005f05f0005f05f00005f05m0*5m0*5m0*5m0*f0*5m0*0 | m0m0m0m0m0m0m0m00m0*0*m0TEGChol |
| hsa-miR-4257 MIMAT0016878 | 5'Pm05f05f05f05f0005f05f05f005f00*0*5m0*5m0*5m0*5m0*0 | m0m0m000m0m0m0m00*0*m0TEGChol |
| hsa-miR-4258 MIMAT0016879 | 5'Pm005f005f05f005f05f0005f0f00*0*5m0*5m0*5m0*5m0*0 | m0m00m0m0m0m000m0m00*m0*m0TEGChol |
| hsa-miR-4259 MIMAT0016880 | 5'Pm05f05f00f05f000f0005f0f00*5m0*5m0****  | m0m0m0m0m0m0m0m00m00*0*m0TEGChol |
| hsa-miR-4260 MIMAT0016881 | 5'Pm0000f05f0005f05f005f0f00*0*5m0*5m0*5m0*5m0*0 | m0m00m00m0m0m0m0m0m0*m0*m0TEGChol |
| hsa-miR-4261 MIMAT0016890 | 5'Pm0005f05f0000f05f05f00f05m0*5m0*0*5m0*f0*0*0 | m0m000m0m00m0m0m0*m0*m0TEGChol |
| hsa-miR-4262 MIMAT0016894 | 5'Pm05f0005f05f000f05f000f05m0*0*0*0*f0*5m0*0 | m0m0m00m0m0m0m0m00*0*m0TEGChol |
| hsa-miR-4263 MIMAT0016898 | 5'Pm05f05f05f05f05f05f05f05f05f005f05m0*0*5m0*0*5m0*5m0*0 | m0m0m000m0000m000*0*m0TEGChol |
| hsa-miR-4264 MIMAT0016899 | 5'Pm05f005f0f005f005f00005f05m0*5m0*0*0*5m0*5m0*0 | m0m0m0m0m0m0m00m00*0*m0TEGChol |
| hsa-miR-4265 MIMAT0016891 | 5'Pm0005f05f0005f0f0005f05f05m0*0*5m0*5m0*f0*5m0*0 | m0m0m0m0m0m0m0m00m0*m0*m0TEGChol |
| hsa-miR-4266 MIMAT0016892 | 5'Pm05f05f05f05f00005f05f0005f05m0*5m0*5m0*0*f0** | m0m0m00m0m0m0m000*0*m0TEGChol |
| hsa-miR-4267 MIMAT0016893 | 5'Pm05f05f005f005f05f05f000f00*0*5m0*0*f0*5m0*0 | m0m00m0m00m0m0m00*0*m0TEGChol |
| hsa-miR-4268 MIMAT0016896 | 5'Pm0000f05f0005f00005f05m0*0*5m0*0*5m0*0*0 | m0m0m0m0m0m0m00m0m0*m0*m0TEGChol |
| hsa-miR-4269 MIMAT0016897 | 5'Pm0000f05f0005f005f05f0f00*5m0*5m0*5m0*5m0*5m0*0 | m0m0m00m0m0m0m0m0*m0*m0TEGChol |
| hsa-miR-4270 MIMAT0016900 | 5'Pm005f00f005f05f05f05f005f05m0*5m0*5m0*5m0*5m0*0 | m0m000m0000m0m00*m0*m0TEGChol |
| hsa-miR-4271 MIMAT0016901 | 5'Pm05f05f05f05f00f0005f05f0*0*5m0*5m0*5m0*0 | m0m0m0m0m0m0m000*m0*m0TEGChol |
| hsa-miR-4272 MIMAT0016902 | 5'Pm0005f05f05f05f005f05f05f05m0*5m0*5m0*f0*5m0*0 | m0m000m0000m0m00*m0*m0TEGChol |
| hsa-miR-4273 MIMAT0016903 | 5'Pm0005f0f005f05f05f05f00f05m*5m0*0*5m0*f0*0*0 | m0m0m0m0m000m0m00*m0*m0TEGChol |
| hsa-miR-4274 MIMAT0016906 | 5'Pm05f05f005f0005f05f05f05f0f00*5m0*5m0*0*5m0*5m0*0 | m0m0000m00m0m0m0*0*m0TEGChol |
| hsa-miR-4275 MIMAT0016905 | 5'Pm0000f00005f00005f00*5m0*0*0*5m0** | m0m0m0m0m0m0m0m0m0m0*m0*m0TEGChol |

TABLE 5-continued

Examples of chemical modification patterns

| miRNA Name | Example of modified AS strand | Example of modified sense strand |
| --- | --- | --- |
| hsa-miR-4276 MIMAT0016904 | 5'Pm005f00f005f00f05f000f00*5m0*0*0*f0*0*0 | m0m0m0m00m0m00m0m0m00*m0*m0TEGChol |
| hsa-miR-4277 MIMAT0016908 | 5'Pm0000f005f05f05f0005f0f00*0*5m0*0*5m0*5m0*0 | m0m00m0m0m000m0m0m0m0*m0*m0TEGChol |
| hsa-miR-4278 MIMAT0016910 | 5'Pm0005f05f05f0005f0000f00*5m0*0*0*** | m0m0m0m0m0m0m0m00m00m0*m0*m0TEGChol |
| hsa-miR-4279 MIMAT0016909 | 5'Pm005f00f05f005f05f005f00f05m0*0*0*5m0*5m0*0*0 | m0m00m0m00m00m0m00*m0*m0TEGChol |
| hsa-miR-4280 MIMAT0016911 | 5'Pm00005f0005f0f05f05f005f05m0*0*0*5m0*5m0*0*0 | m0m00m00m00m0m0m0m0m0*m0*m0TEGChol |
| hsa-miR-4281 MIMAT0016907 | 5'Pm0000f05f005f05f05f005f0f00*0*5m0*5m0*5m0*5m0*0 | m0m00m00m0m0m0m0m0m0*m0*m0TEGChol |
| hsa-miR-4282 MIMAT0016912 | 5'Pm005f05f0f05f05f00f05f05f005f00*5m0*0*0*5m0*5m0*0 | m0m0m000m0m000m000*m0*m0TEGChol |
| hsa-miR-4283 MIMAT0016914 | 5'Pm0000f05f005f05f05f005f0f00*0*5m0*5m0*5m0*5m0*0 | m0m00m00m0m0m0m0m0m0*m0*m0TEGChol |
| hsa-miR-4284 MIMAT0016915 | 5'Pm0000f05f005f0f0000f00*0*5m0*0*5m0*0*0 | m0m0m0m0m00m00m0m0m0*m0*m0TEGChol |
| hsa-miR-4285 MIMAT0016913 | 5'Pm0000f05f005f05f05f05f05f00*0*5m0*0*f0*0*0 | m0m0000m0m000m0m0m0*m0*m0TEGChol |
| hsa-miR-4286 MIMAT0016916 | 5'Pm05f05f05f05f00005f05f005f05f05m0*5m0*0*0*f0*5m0*0 | m0m0m00m0m00m0m0m000*0*m0TEGChol |
| hsa-miR-4287 MIMAT0016917 | 5'Pm005f005f05f05f00f05f05f05f0f05m0*5m0*0*0*5m0*0*0 | m0m0000m0m000m0m00*m0*m0TEGChol |
| hsa-miR-4288 MIMAT0016918 | 5'Pm05f000f005f00f005f00f00*0*0*0*5m0*5m0*0 | m0m0m00m0m00m0m0m0m0*0*m0TEGChol |
| hsa-miR-4289 MIMAT0016920 | 5'Pm05f05f00f005f05f05f0000f05m0*5m0*0*0*f0*0*0 | m0m0m0m0m0m000m0m00*0*m0TEGChol |
| hsa-miR-429 MIMAT0001536 | 5'Pm05f05f05f05f05f00f00005f05m0*5m0*0*0*f0*5m0*0 | m0m0m0m0m0m000m000*m0*m0TEGChol |
| hsa-miR-4290 MIMAT0016921 | 5'Pm05f005f0f05f0005f05f005f05m0*0*5m0*5m0*5m0*5m0*0 | m0m000m0m00m00m0*0*m0TEGChol |
| hsa-miR-4291 MIMAT0016922 | 5'Pm0000f005f005f05f05f005f00*5m0*5m0*5m0*5m0*0 | m0m000m0m00m0m0m0m0*m0*m0TEGChol |
| hsa-miR-4292 MIMAT0016919 | 5'Pm05f000f005f00f005f00f00*0*0*5m0*5m0*0 | m0m00m0m00m00m0m0m0*0*m0TEGChol |
| hsa-miR-4293 MIMAT0016848 | 5'Pm0000f05f00f05f005f00f00*0*5m0*5m0*5m0*0 | m0m000m0m00m0m0m0m0*m0*m0TEGChol |
| hsa-miR-4294 MIMAT0016849 | 5'Pm0005f0f05f00f00005f00*0*5m0*5m0*5m0*5m0*0 | m0m0m0m0m0m0m0m0m0*m0*m0TEGChol |
| hsa-miR-4295 MIMAT0016844 | 5'Pm0005f0f005f005f0005f05f00*0*5m0*5m0*f0*0*0 | m0m00m0m00m0m00m0*m0*m0TEGChol |
| hsa-miR-4296 MIMAT0016845 | 5'Pm05f05f05f05f0005f05f05f00f00*5m0*5m0*5m0*5m0*0*0 | m0m000m00m0m0m000*0*m0TEGChol |
| hsa-miR-4297 MIMAT0016846 | 5'Pm05f005f05f0005f05f005f0f05m0*0*0*f0*0*0 | m0m00m00m0m0m0m0m0m0*0*m0TEGChol |
| hsa-miR-4298 MIMAT0016852 | 5'Pm0005f0f0000f05f05f05f0f05m0*5m0*0*5m0*f0*5m0*0 | m0m0000m0m0m0m0m0m0*m0*m0TEGChol |
| hsa-miR-4299 MIMAT0016851 | 5'Pm0000f05f05f0f05f0005f00*0*0*0*** | m0m0m0m00m0000m0m0*m0*m0TEGChol |
| hsa-miR-4300 MIMAT0016853 | 5'Pm005f005f05f005f05f05f0005f00*0*5m0*5m0*f0*5m0*0 | m0m0m00m00m00m0m00*m0*m0TEGChol |
| hsa-miR-4301 MIMAT0016850 | 5'Pm05f05f00f0005f05f0000f05m0*0*5m0*0*f0*5m0*0 | m0m0m0m0m0m0m0m00*0*m0TEGChol |
| hsa-miR-4302 MIMAT0016855 | 5'Pm05f05f05f05f005f005f005f05f05m0*0*5m0*5m0*5m0*5m0*0 | m0m00m0m0m0m0m000*0*m0TEGChol |
| hsa-miR-4303 MIMAT0016856 | 5'Pm0005f0f05f0005f005f05f05m0*5m0*5m0*5m0*5m0*5m0** | m0m000m0m00m00m0m0*m0*m0TEGChol |
| hsa-miR-4304 MIMAT0016854 | 5'Pm0000f005f00f005f00f05m0*0*0*f0*0*0 | m0m00m00m0m0m0m0m0m0*m0*m0TEGChol |
| hsa-miR-4305 MIMAT0016857 | 5'Pm005f05f0f05f05f00f05f005f05m0*0*0*0*5m0*0*0 | m0m000m0m00m000*m0*m0TEGChol |
| hsa-miR-4306 MIMAT0016858 | 5'Pm005f05f05f05f00f005f05f00*5m0*5m0*5m0*5m0*0 | m0m000m0m0m0m0m0m000*m0*m0TEGChol |
| hsa-miR-4307 MIMAT0016860 | 5'Pm05f005f0f005f05f0005f05f05m0*5m0*5m0*0*5m0*5m0*0 | m0m00m000m0m00m0m0*0*m0TEGChol |
| hsa-miR-4308 MIMAT0016861 | 5'Pm005f00f005f05f005f05f0f00*5m0*5m0*5m0*5m0* | m0m000m0m00m000m0m0*m0*m0TEGChol |
| hsa-miR-4309 MIMAT0016859 | 5'Pm0005f05f05f00f05f05f05f0f05m0*0*5m0*5m0*5m0*5m0*0 | m0m00m0m000m00m0*m0*m0TEGChol |
| hsa-miR-431 MIMAT0001625 | 5'Pm0000f05f000f05f000f00*0*0*0*f0*0* | m0m0m0m0m0m0m0m0m0*m0*m0TEGChol |
| hsa-miR-431* MIMAT0004757 | 5'Pm00005f05f05f05f05f05f00f00*5m0*5m0*5m0*5m0*5m0*0 | m0m000m0m0000m0m0*m0*m0TEGChol |
| hsa-miR-4310 MIMAT0016862 | 5'Pm0000f05f005f05f05f005f0f00*5m0*0*5m0*f0*0*0 | m0m00m00m0m0m0m0m0*m0*m0TEGChol |

TABLE 5-continued

Examples of chemical modification patterns

| miRNA Name | Example of modified AS strand | Example of modified sense strand |
|---|---|---|
| hsa-miR-4311 MIMAT0016863 | 5'Pm005f05f0f05f005f05f05f005f05f05m0\*5m0\*0\*0\*5m0\*5m0\*0 | m0m00m00m00m00m000\*m0\*m0TEGChol |
| hsa-miR-4312 MIMAT0016864 | 5'Pm05f05f005f0000f05f05f05f0f05m0\*5m0\*5m0\*5m0\*f0\*0\*0 | m0m0000m0m0m0m0m0m00\*0\*m0TEGChol |
| hsa-miR-4313 MIMAT0016865 | 5'Pm005f05f0f0005f05f0005f05f00\*5m0\*0\*0\*f0\*0\*0 | m0m0m0m0m00m0m0m0m000\*m0\*m0TEGChol |
| hsa-miR-4314 MIMAT0016868 | 5'Pm05f000f005f05f0f05f0005f05m0\*0\*5m0\*5m0\*5m0\*5m0\*0 | m0m0m0m00m000m0m0m0m0\*0\*m0TEGChol |
| hsa-miR-4315 MIMAT0016866 | 5'Pm05f000f005f05f0f0000f00\*5m0\*0\*5m0\*5m0\*5m0\*0 | m0m0m0m0m000m0m0m0m0\*0\*m0TEGChol |
| hsa-miR-4316 MIMAT0016867 | 5'Pm005f05f0f005f005f05f005f05m0\*0\*0\*5m0\*5m0\*5m0\*0 | m0m0m000m0m0m0m000\*m0\*m0TEGChol |
| hsa-miR-4317 MIMAT0016872 | 5'Pm05f005f0f0005f05f000f05m0\*5m0\*5m0\*0\*\*\* | m0m0m00m0m0m0m00m00\*0\*m0TEGChol |
| hsa-miR-4318 MIMAT0016869 | 5'Pm05f05f00f005f05f05f0000f00\*5m0\*0\*0\*f0\*0\* | m0m0m0m0m000m0m0m0m00\*0\*m0TEGChol |
| hsa-miR-4319 MIMAT0016870 | 5'Pm05f05f00f005f05f05f0000f05m0\*5m0\*0\*0\*f0\*0\*0 | m0m0m0m0m000m0m0m0m00\*0\*m0TEGChol |
| hsa-miR-432 MIMAT0002814 | 5'Pm005f05f05f05f05f05f05f005f05f05f00\*5m0\*0\*\*\*\* | m0m000m0m0000m000\*m0\*m0TEGChol |
| hsa-miR-432\* MIMAT0002815 | 5'Pm05f05f005f05f05f0f05f000f05m0\*0\*5m0\*5m0\*5m0\*0\*0 | m0m0m0m0m000m0m0m00\*0\*m0TEGChol |
| hsa-miR-4320 MIMAT0016871 | 5'Pm05f0005f0000f005f05f0f05m0\*5m0\*5m0\*5m0\*f0\*0\*0 | m0m000m0m0m0m0m0m0m0\*0\*m0TEGChol |
| hsa-miR-4321 MIMAT0016874 | 5'Pm0000f05f05f00f0000f05m0\*0\*5m0\*5m0\*f0\*0\*0 | m0m0m0m0m0m0m0m0m0m0\*m0\*m0TEGChol |
| hsa-miR-4322 MIMAT0016873 | 5'Pm0005f0f0005f05f005f00f00\*0\*5m0\*0\*5m0\*0\*0 | m0m00m00m00m0m0m00\*m0\*m0TEGChol |
| hsa-miR-4323 MIMAT0016875 | 5'Pm0000f05f005f05f05f005f0f05f00\*5m0\*0\*5m0\*f0\*0\*0 | m0m00m00m0m0m0m0m0\*m0\*m0TEGChol |
| hsa-miR-4324 MIMAT0016876 | 5'Pm05f05f005f0005f0f05f000f05m0\*0\*5m0\*5m0\*5m0\*5m0\*0 | m0m0m0m00m00m0m0m00\*0\*m0TEGChol |
| hsa-miR-4325 MIMAT0016887 | 5'Pm00005f005f00f05f0005f00\*0\*0\*0\*f0\*\* | m0m0m0m0m00m0m0m0m0m0\*m0\*m0TEGChol |
| hsa-miR-4326 MIMAT0016888 | 5'Pm0005f05f005f05f0f05f0005f00\*5m0\*5m0\*0\*f0\*5m0\*0 | m0m0m00m000m0m0m0\*m0\*m0TEGChol |
| hsa-miR-4327 MIMAT0016889 | 5'Pm05f000f005f00f0000f00\*0\*0\*0\*f0\*0\*0 | m0m0m0m0m00m0m0m0m0\*0\*m0TEGChol |
| hsa-miR-4328 MIMAT0016926 | 5'Pm05f000f05f000f005f05f05f05m0\*0\*5m0\*0\*5m0\*0\*0 | m0m0m0m0m00m0m0m0m0\*0\*m0TEGChol |
| hsa-miR-4329 MIMAT0016923 | 5'Pm05f0005f005f05f0f05f000f00\*5m0\*0\*5m0\*5m0\*5m0\*0 | m0m0m0m00m000m0m0m0\*0\*m0TEGChol |
| hsa-miR-433 MIMAT0001627 | 5'Pm05f05f005f00005f005f05f05f05m0\*5m0\*5m0\*0\*f0\*5m0\*0 | m0m0m0m0m00m00m0m0m00\*0\*m0TEGChol |
| hsa-miR-4330 MIMAT0016924 | 5'Pm005f005f0005f0f05f0005f05m0\*5m0\*0\*5m0\*5m0\*5m0\*0 | m0m0m00m00m0m0m0m0\*m0\*m0TEGChol |
| hsa-miR-448 MIMAT0001532 | 5'Pm05f05f00f05f0005f005f00f00\*0\*0\*0\*5m0\*\* | m0m00m00m0m0m0m0m0m00\*0\*m0TEGChol |
| hsa-miR-449a MIMAT0001541 | 5'Pm005f005f0005f0f05f0005f05m\*5m0\*0\*5m0\*f0\*5m0\*0 | m0m0m0m0m0m0m0m0m0\*m0\*m0TEGChol |
| hsa-miR-449b MIMAT0003327 | 5'Pm0005f05f0005f05f05f00f00\*0\*5m0\*0\*5m0\*0\*0 | m0m0m0m0m0m0m0m00\*m0\*m0TEGChol |
| hsa-miR-449b\* MIMAT0009203 | 5'Pm05f005f0f05f0005f0000f05m0\*0\*0\*0\*5m0\*5m0\*0 | m0m0m0m0m00m00m0\*0\*m0TEGChol |
| hsa-miR-449c MIMAT0010251 | 5'Pm0000f05f005f05f05f05f05f05m0\*0\*0\*0\*5m0\*0\*0 | m0m0000m00m00m0m0m0\*m0\*m0TEGChol |
| hsa-miR-449c\* MIMAT0013771 | 5'Pm0005f05f05f005f00005f05m0\*0\*0\*5m0\*f0\*5m0\*0 | m0m0m0m0m00m00m00\*m0\*m0TEGChol |
| hsa-miR-450a MIMAT0001545 | 5'Pm0005f05f05f00f05f00f05f00f05m0\*0\*0\*5m0\*5m0\*0 | m0m000m00m00m0\*m0\*m0TEGChol |
| hsa-miR-450b-3p MIMAT0004910 | 5'Pm05f005f0f05f05f05f0f05f05f05f0f00\*5m0\*5m0\*5m0\*5m0\*5m0\*0 | m0m0000m0000m0m0\*0\*m0TEGChol |
| hsa-miR-450b-5p MIMAT0004909 | 5'Pm05f05f0f05f005f05f0f05f0005f00\*0\*5m0\*0\*f0\*5m0\*0 | m0m0m00m0m0m00m00\*0\*m0TEGChol |
| hsa-miR-451 MIMAT0001631 | 5'Pm05f05f05f05f05f05f0f05f05f005f05m0\*5m0\*5m0\*5m0\*5m0\*0\*0 | m0m000m0000m000\*0\*m0TEGChol |
| hsa-miR-452 MIMAT0001635 | 5'Pm0000f05f0005f00005f00\*0\*5m0\*0\*5m0\*5m0 | m0m0m0f0m0m0m0m00m0m0m0\*m0\*m0TEGChol |
| hsa-miR-452\* MIMAT0001636 | 5'Pm0005f05f0000f0000f00\*0\*5m0\*0\*5m0\*5m0\*0 | m0m0m0m0m0m0m0m0m00m0\*m0\*m0TEGChol |
| hsa-miR-454 MIMAT0003885 | 5'Pm005f005f0000f005f00f00\*5m0\*5m0\*5m0\*5m0\*0 | m0m0m00m0m0m0m00m0m0m00\*m0\*m0TEGChol |
| hsa-miR-454\* MIMAT0003884 | 5'Pm05f05f00f05f05f05f05f05f05f00\*0\*5m0\*5m0\*f0\*0\*0 | m0m0000m0000m0m0\*0\*m0TEGChol |
| hsa-miR-455-3p MIMAT0004784 | 5'Pm00005f05f005f05f05f005f0f00\*5m0\*0\*0\*f0\*5m0\*0 | m0m00m00m00m0m0m0m0\*m0\*m0TEGChol |

TABLE 5-continued

Examples of chemical modification patterns

| miRNA Name | Example of modified AS strand | Example of modified sense strand |
| --- | --- | --- |
| hsa-miR-455-5p MIMAT0003150 | 5'Pm05f000f0000f05f0005f05m0*0*5m0*5m0*f0*0*0 | m0m0m0m00m0m0m0m0m0m0m0*0*m0TEGChol |
| hsa-miR-466 MIMAT0015002 | 5'Pm0000f005f05f0f0000f00*0*5m0*0*5m0*0*0 | m0m0m0m0m00m0m0m0m0*m0*m0TEGChol |
| hsa-miR-483-3p MIMAT0002173 | 5'Pm0000f05f0005f00005f05m0*0*5m0*0*5m0*0*0 | m0m0m0m0m0m00m0m0m0m0*m0*m0TEGChol |
| hsa-miR-483-5p MIMAT0004761 | 5'Pm05f05f00f05f000f05f005f05f05m0*0*5m0*5m0*f0*0*0 | m0m00m00m0m0m00m0m00*0*m0TEGChol |
| hsa-miR-484 MIMAT0002174 | 5'Pm05f05f05f0f05f005f05f0005f05m0*5m0*5m0*0*5m0*5m0*0 | m0m0m0m00m0m00m0m000*0*m0TEGChol |
| hsa-miR-485-3p MIMAT0002176 | 5'Pm0005f05f05f05f05f05f05f05f05f00*0*0*0*5m0*0*0 | m0m0000m0000m0m0*m0*m0TEGChol |
| hsa-miR-485-5p MIMAT0002175 | 5'Pm05f05f05f0f05f005f05f05f05f00*0*0*5m0*0*0 | m0m0000m00m00m000*0*m0TEGChol |
| hsa-miR-486-3p MIMAT0004762 | 5'Pm0005f05f005f00f05f05f05f05m0*5m0*0*0*f0*0*0 | m0m0000m0m00m0m00m0*m0*m0TEGChol |
| hsa-miR-486-5p MIMAT0002177 | 5'Pm00005f05f05f05f0f0005f0f00*0*0*0*f0*5m0*0 | m0m0m0m0m0000m0m0m0*m0*m0TEGChol |
| hsa-miR-487a MIMAT0002178 | 5'Pm005f05f05f05f000f00005f00*5m0*5m0*0*5m0*5m0*0 | m0m0m0m0m0m0m00m000*m0*m0TEGChol |
| hsa-miR-487b MIMAT0003180 | 5'Pm0000f005f05f0f0005f05f00*5m0*5m0*5m0*5m0** | m0m00m0m0m000m0m0m0m0*m0*m0TEGChol |
| hsa-miR-488 MIMAT0004763 | 5'Pm05f05f05f0f05f05f005f05f05f0f05m0*5m0*5m0*0*5m0*0*0 | m0m0000m0m000m000*0*m0TEGChol |
| hsa-miR-488* MIMAT0002804 | 5'Pm05f05f0f05f000f05f005f0f00*5m0*0*0*5m0*5m0*0 | m0m00m00m0m0m00m000*m0*m0TEGChol |
| hsa-miR-489 MIMAT0002805 | 5'Pm0005f0f05f05f05f05f00005f00*5m0*5m0*5m0*f0*0*0 | m0m0m0m0m0000m00m0*m0*m0TEGChol |
| hsa-miR-490-3p MIMAT0002806 | 5'Pm005f0f0000f05f05f00f00*0*5m0*5m0*f0*5m0*0 | m0m000m0m0m0m0m0m0*m0*m0TEGChol |
| hsa-miR-490-5p MIMAT0004764 | 5'Pm005f05f05f05f005f0005f05m0*5m0*5m0*0*f0*5m0*0 | m0m0m0m0m000m000*m0*m0TEGChol |
| hsa-miR-491-3p MIMAT0004765 | 5'Pm05f005f0f0000f0000f00*0*5m0*5m0*5m0*5m0*0 | m0m0m0m0m0m0m0m00m0*0*m0TEGChol |
| hsa-miR-491-5p MIMAT0002807 | 5'Pm05f0005f005f00f05f05f05f0f00*5m0*0*0*f0** | m0m0000m00m0m0m0*0*m0TEGChol |
| hsa-miR-492 MIMAT0002812 | 5'Pm0005f05f0005f0f05f005f05m0*0*5m0*0*f0*0*0 | m0m00m00m0m0m00m0*m0*m0TEGChol |
| hsa-miR-493 MIMAT0003161 | 5'Pm0005f05f0000f0005f0f00*5m0*5m0*0*5m0*0*0 | m0m0m0m0m0m0m0m0*m0*m0TEGChol |
| hsa-miR-493* MIMAT0002813 | 5'Pm05f05f05f0f0005f05f0000f00*5m0*0*0** | m0m0m0m0m0m0m000*0*m0TEGChol |
| hsa-miR-494 MIMAT0002816 | 5'Pm05f05f00f05f005f0f0000f05m0*0*0*5m0*f0*0*0 | m0m0m0m00m00m00*0*m0TEGChol |
| hsa-miR-495 MIMAT0002817 | 5'Pm005f005f05f005f05f05f0f05m0*5m0*0*5m0*5m0*0*0 | m0m000m0m00m0m0m0*m0*m0TEGChol |
| hsa-miR-496 MIMAT0002818 | 5'Pm05f0005f005f005f05f05f00f00*0*5m0*0*** | m0m000m0m0m0m0m0*0*m0TEGChol |
| hsa-miR-497 MIMAT0002820 | 5'Pm05f05f05f05f05f000f0005f05f00*5m0*5m0*f0*5m0*0 | m0m0m0m0m0m00m000*0*m0TEGChol |
| hsa-miR-497* MIMAT0004768 | 5'Pm0005f0f05f05f05f05f00005f05m0*0*0*5m0*5m0*5m0*0 | m0m0m0m0m0000m00m0*m0*m0TEGChol |
| hsa-miR-498 MIMAT0002824 | 5'Pm05f05f00f005f005f05f05f05f00*0*5m0*5m0*5m0** | m0m0000m0m00m0m00*0*m0TEGChol |
| hsa-miR-499-3p MIMAT0004772 | 5'Pm0000f0000f00005f00*0*5m0*0*** | m0m0m0m00m0m0m0m0m0m0m0*m0*m0TEGChol |
| hsa-miR-499-5p MIMAT0002870 | 5'Pm0005f0f005f005f00005f00*0*0*5m0*5m0*0*0 | m0m0m0m0m00m0m00m0*m0*m0TEGChol |
| hsa-miR-500a MIMAT0004773 | 5'Pm05f05f00f05f05f05f05f05f05f05f00*0*5m0*5m0*f0*0*0 | m0m0000m0000m0m00*0*m0TEGChol |
| hsa-miR-500a* MIMAT0002871 | 5'Pm0000f005f005f05f05f05f0f00*0*0*0*f0*5m0*0 | m0m00m00m0m0m0m0*m0*m0TEGChol |
| hsa-miR-500b MIMAT0016925 | 5'Pm05f0f05f05f05f0f005f05f05f00*5m0*0*5m0*f0*0*0 | m0m000m0m000m0m0m0*m0*m0TEGChol |
| hsa-miR-501-3p MIMAT0004774 | 5'Pm005f05f05f05f05f0f00005f05m0*5m0*0*5m0*f0*0*0 | m0m0m0m0m0000m000*m0*m0TEGChol |
| hsa-miR-501-5p MIMAT0002872 | 5'Pm005f00f05f05f005f05f005f00*0*0*5m0*5m0*0 | m0m0m0m0m0m00m00*0*m0TEGChol |
| hsa-miR-502-3p MIMAT0004775 | 5'Pm0000f05f005f0f00005f05m0*0*0*0*f0*5m0*0 | m0m0m0m0m00m0m0m0m0*m0*m0TEGChol |
| hsa-miR-502-5p MIMAT0002873 | 5'Pm05f05f05f05f05f005f00005f00*5m0*5m0*5m0*f0*0*0 | m0m0m0m0m0m00m000*m0*m0TEGChol |
| hsa-miR-503 MIMAT0002874 | 5'Pm05f05f005f05f05f005f005f05f05m0*0*5m0*0*f0*5m0*0 | m0m000m0m000m0m0m0*0*m0TEGChol |
| hsa-miR-504 MIMAT0002875 | 5'Pm005f005f05f05f005f05f005f05f00*5m0*5m0*0*f0*5m0*0 | m0m00m00m0m000m0m0*m0*m0TEGChol |

TABLE 5-continued

Examples of chemical modification patterns

| miRNA Name | Example of modified AS strand | Example of modified sense strand |
| --- | --- | --- |
| hsa-miR-505 MIMAT0002876 | 5'Pm005f05f0f00005f05f05f005f00*0*0*0*f0*5m0*0 | m0m0m000m0m0m0m0m000*m0*m0TEGChol |
| hsa-miR-505* MIMAT0004776 | 5'Pm005f005f05f005f0f005f05f05f0f05m0*5m0*5m0*0*f0*0*0 | m0m000m0m0m0m00m0m0m0*m0*m0TEGChol |
| hsa-miR-506 MIMAT0002878 | 5'Pm05f05f05f05f05f00f05f05f005f0f00*0*0*0*f0*5m0*0 | m0m00m0m0m000m000*m0*m0TEGChol |
| hsa-miR-507 MIMAT0002879 | 5'Pm05f0005f05f0005f05f05f05f05f00*5m0*5m0*5m0*5m0** | m0m0000m0m0m00m0m0m0*0*m0TEGChol |
| hsa-miR-508-3p MIMAT0002880 | 5'Pm05f05f05f05f05f005f0f05f05f00f00*0*0*5m0*5m0*5m0*0 | m0m000m00m00m000*0*m0TEGChol |
| hsa-miR-508-5p MIMAT0004778 | 5'Pm005f05f0f05f000f05f0005f00*0*5m0*0*f0*5m0*0 | m0m0m00m0m0m00m000*m0*m0TEGChol |
| hsa-miR-509-3-5p MIMAT0004975 | 5'Pm005f005f05f05f05f05f05f05f05f00*5m0*5m0*5m0*5m0*5m0* | m0m0000m0000m0m00*m0*m0TEGChol |
| hsa-miR-509-3p MIMAT0002881 | 5'Pm05f000f0000f0000f05m0*5m0*5m0*0*f0*5m0*0 | m0m0m0m0m0m0m0m0m0m0m0*0*m0TEGChol |
| hsa-miR-509-5p MIMAT0004779 | 5'Pm005f05f05f0000f00005f00*0*5m0*0*f0*5m0*0 | m0m0m0m0m0m0m0m0m000*m0*m0TEGChol |
| hsa-miR-510 MIMAT0002882 | 5'Pm05f05f005f005f05f0f005f05f05f00*5m0*5m0*0*f0*0*0 | m0m000m0m000m0m0m00*0*m0TEGChol |
| hsa-miR-511 MIMAT0002808 | 5'Pm005f05f05f05f05f05f05f005f05f0f05m0*0*5m0*5m0*f0*5m0*0 | m0m0m0m0m0000m000*m0*m0TEGChol |
| hsa-miR-512-3p MIMAT0002823 | 5'Pm005f05f0f05f005f05f05f05f05f05m0*5m0*5m0*5m0*5m0*0*0 | m0m0000m00m00m000*m0*m0TEGChol |
| hsa-miR-512-5p MIMAT0002822 | 5'Pm005f05f05f05f05f05f05f005f05f00*0*0*0*f0*5m0*0 | m0m00m0m0000m000*m0*m0TEGChol |
| hsa-miR-513a-3p MIMAT0004777 | 5'Pm005f00f05f05f00f05f05f00f05m0*5m0*0*0*f0*0*0 | m0m000m0m000m0m00*m0*m0TEGChol |
| hsa-miR-513a-5p MIMAT0002877 | 5'Pm05f05f05f0f05f000f05f000f00*0*5m0*5m0*5m0*5m0*0 | m0m0m0m00m0m0m000*0*m0TEGChol |
| hsa-miR-513b MIMAT0005788 | 5'Pm0005f05f05f000f005f05f05f05m0*5m0*0*0*f0*0*0 | m0m000m0m0m00m0m0m0*m0*m0TEGChol |
| hsa-miR-513c MIMAT0005789 | 5'Pm05f005f05f05f05f05f005f05f05m0*0*5m0*0*f0*5m0*0 | m0m000m0m0000m00m0*0*m0TEGChol |
| hsa-miR-514 MIMAT0002883 | 5'Pm05f000f05f05f00f005f05f0f05m0*0*5m0*5m0*f0*5m0*0 | m0m0m0m000m0m0m0*0*m0TEGChol |
| hsa-miR-514b-3p MIMAT0015088 | 5'Pm05f000f0005f0f05f000f00*0*0*0*5m0*5m0*0 | m0m0m0m00m00m0m0m0m0*0*m0TEGChol |
| hsa-miR-514b-5p MIMAT0015087 | 5'Pm05f0005f05f000f005f05f05f05m0*0*0*5m0*5m0*0*0 | m0m0m0m00m00m0m0m0*0*m0TEGChol |
| hsa-miR-515-3p MIMAT0002827 | 5'Pm0005f0f005f05f05f0000f00*5m0*5m0*5m0*f0*5m0*0 | m0m0m0m00m000m0m0m0*m0*m0TEGChol |
| hsa-miR-515-5p MIMAT0002826 | 5'Pm05f05f05f05f0000f05f05f05f05m0*5m0*5m0*5m0*5m0** | m0m0000m0m0m0m000*0*m0TEGChol |
| hsa-miR-516a-3p MIMAT0006778 | 5'Pm005f00f005f05f05f05f05f00f00*0*5m0*0*f0*0* | m0m000m00m0m0m0m0*m0*m0TEGChol |
| hsa-miR-516a-5p MIMAT0004770 | 5'Pm0000f005f00f05f05f005f00*0*5m0*5m0*5m0*5m0*0 | m0m0m00m0m0m0m0m0*m0*m0TEGChol |
| hsa-miR-516b MIMAT0002859 | 5'Pm0000f005f05f0f05f0005f05m0*0*5m0*5m0*5m0*5m0*0 | m0m0m00m000m0m0m0*m0*m0TEGChol |
| hsa-miR-516b* MIMAT0002860 | 5'Pm05f05f05f0f05f05f05f05f005f05f00*5m0*5m0*5m0*5m0*5m0*0 | m0m0m0m0000m000*0*m0TEGChol |
| hsa-miR-517* MIMAT0002851 | 5'Pm05f000f005f05f05f0000f05m0*5m0*5m0*5m0*f0** | m0m0m0m00m000m0m0m0*0*m0TEGChol |
| hsa-miR-517a MIMAT0002852 | 5'Pm05f05f05f05f05f05f0f05f005f0f00*0*5m0*0*5m0*5m0*0 | m0m00m00m0000m000*0*m0TEGChol |
| hsa-miR-517b MIMAT0002857 | 5'Pm05f005f05f05f05f05f05f05f05f05m0*5m0*5m0*5m0*5m0*5m0*0 | m0m0000m0000m0m0*0*m0TEGChol |
| hsa-miR-517c MIMAT0002866 | 5'Pm05f0005f005f05f0f0005f05f05m0*0*0*5m0*5m0*5m0*0 | m0m0m0m0m0m0m0m0*0*m0TEGChol |
| hsa-miR-518a-3p MIMAT0002863 | 5'Pm0005f0f005f05f05f05f00f05m0*5m0*0*5m0*f0*0*0 | m0m000m0m0m0m0m0*m0*m0TEGChol |
| hsa-miR-518a-5p MIMAT0005457 | 5'Pm05f000f005f05f05f0f05f00f00*0*5m0*5m0*5m0*5m0*0 | m0m0m000m0m0m0m0m0*0*m0TEGChol |
| hsa-miR-518b MIMAT0002844 | 5'Pm05f0005f00005f005f00f00*5m0*0*0*f0*5m0*0 | m0m00m0m0m0m0m0m0m0*0*m0TEGChol |
| hsa-miR-518c MIMAT0002848 | 5'Pm005f05f05f005f005f005f05f005f05m0*5m0*0*5m0*5m0*0*0 | m0m0m0m000m0m0m0*m0*m0TEGChol |
| hsa-miR-518c* MIMAT0002847 | 5'Pm005f05f0f05f0005f05f005f05f05m0*5m0*5m0*0*5m0*0*0 | m0m00m0m00m0m0m000*m0*m0TEGChol |
| hsa-miR-518d-3p MIMAT0002864 | 5'Pm0005f005f05f005f00005f05m0*0*0*5m0*f0*0*0 | m0m0m0m0m000m0m0m0*0*m0TEGChol |
| hsa-miR-518d-5p MIMAT0005456 | 5'Pm005f05f00005f0005f0f00*5m0*5m0*0*5m0*0*0 | m0m00m0m0m0m0m0m00*m0*m0TEGChol |
| hsa-miR-518e MIMAT0002861 | 5'Pm005f00f05f05f05f05f05f0f005f05m0*5m0*5m0*5m0*f0*5m0*0 | m0m0m000m0000m0m00*m0*m0TEGChol |

TABLE 5-continued

Examples of chemical modification patterns

| miRNA Name | Example of modified AS strand | Example of modified sense strand |
|---|---|---|
| hsa-miR-518e* MIMAT0005450 | 5'Pm005f005f005f05f0f05f0005f05m0*0*5m0*5m0*5m0*5m0*0 | m0m0m0m00m000m0m0m00*m0*m0TEGChol |
| hsa-miR-518f MIMAT0002842 | 5'Pm0005f05f05f05f00f05f05f00f05m0*0*5m0*5m0*0*0 | m0m0m000m0m0m00m00*m0*m0TEGChol |
| hsa-miR-518f* MIMAT0002841 | 5'Pm0005f05f05f00f0005f05f05m0*0*0*f0*5m0* | m0m0m0m0m0m00m0m00m0*m0*m0TEGChol |
| hsa-miR-519a MIMAT0002869 | 5'Pm0005f05f05f05f05f0f05f000f05m0*0*0*0*5m0*0*0 | m0m0m00m0m0000m0m0*m0*m0TEGChol |
| hsa-miR-519a* MIMAT0005452 | 5'Pm00005f05f05f05f05f0f05f0005f00*5m0*5m0*5m0*5m0*5m0*0 | m0m0m00m0m0000m0m0m0*m0*m0TEGChol |
| hsa-miR-519b-3p MIMAT0002837 | 5'Pm005f05f0f05f005f05f0000f00*5m0*5m0*0*f0*5m0*0 | m0m0m0m0m0m00m000*m0*m0TEGChol |
| hsa-miR-519b-5p MIMAT0005454 | 5'Pm0005f05f05f05f0f05f0000f05m0*5m0*0*0*f0*0*0 | m0m0m0m0m000m0m0m0*m0*m0TEGChol |
| hsa-miR-519c-3p MIMAT0002832 | 5'Pm05f005f0f05f05f05f0f005f05f05f00*0*5m0*5m0*f0*5m0*0 | m0m000m0m0000m00m0*0*m0TEGChol |
| hsa-miR-519c-5p MIMAT0002831 | 5'Pm05f05f05f0f0005f005f05f000f05m0*5m0*5m0*0*5m0*0*0 | m0m0m0m0m00m0m0m0m000*0*m0TEGChol |
| hsa-miR-519d MIMAT0002853 | 5'Pm05f0005f05f05f05f0f05f05f00f00*5m0*0*5m0*5m0*0*0 | m0m000m0000m0m0m0*0*m0TEGChol |
| hsa-miR-519e MIMAT0002829 | 5'Pm05f05f05f05f0005f05f005f05f0f0*0*0*5m0*0*0 | m0m000m0m0m0m00m000*m0*m0TEGChol |
| hsa-miR-519e* MIMAT0002828 | 5'Pm005f05f05f05f005f0f0005f05f00*5m0*5m0*0*5m0*0*0 | m0m00m0m00m00m000*m0*m0TEGChol |
| hsa-miR-520a-3p MIMAT0002834 | 5'Pm005f00f00005f05f000f00*5m0*5m0*0*5m0*0*0 | m0m0m00m0m0m0m0m0m0m00*m0*m0TEGChol |
| hsa-miR-520a-5p MIMAT0002833 | 5'Pm0000f05f0005f005f05f0f00*0*0*5m0*f0*0*0 | m0m000m0m0m0m00m0m0*m0*m0TEGChol |
| hsa-miR-520b MIMAT0002843 | 5'Pm005f00f05f05f05f05f05f005f05m0*5m0*5m0*5m0*f0*5m0*0 | m0m0m000m0000m0m00*m0*m0TEGChol |
| hsa-miR-520c-3p MIMAT0002846 | 5'Pm05f005f0f00005f05f000f00*0*5m0*5m0*f0*5m0*0 | m0m0m00m0m0m0m0m00m0*0*m0TEGChol |
| hsa-miR-520c-5p MIMAT0005455 | 5'Pm00005f005f05f05f05f05f05f05m0*0*5m0*5m0*5m0*5m0*0 | m0m0000m000m0m0m0*m0*m0TEGChol |
| hsa-miR-520d-3p MIMAT0002856 | 5'Pm05f05f05f05f005f05f05f005f05f05m0*0*0*5m0*f0*0*0 | m0m0m0m000m0m000*0*m0TEGChol |
| hsa-miR-520d-5p MIMAT0002855 | 5'Pm0000f05f05f05f05f05f000f05m0*5m0*5m0*5m0*f0*0*0 | m0m0m00m0000m0m0*m0*m0TEGChol |
| hsa-miR-520e MIMAT0002825 | 5'Pm005f05f0f05f05f005f05f05f0f00*0*5m0*0*f0*0*0 | m0m0000m0m000m000*m0*m0TEGChol |
| hsa-miR-520f MIMAT0002830 | 5'Pm0000f0000f05f05f00f00*5m0*5m0*5m0*f0*5m0*0 | m0m000m0m0m0m0m0m0m0*m0*m0TEGChol |
| hsa-miR-520g MIMAT0002858 | 5'Pm005f00f05f05f05f05f005f05f0f00*0*5m0*0*5m0*5m0*0 | m0m0m0000m0m00*m0*m0TEGChol |
| hsa-miR-520h MIMAT0002867 | 5'Pm00005f05f000f05f05f05f00*0*5m0*0*5m0*5m0*0 | m0m0000m0m00m0m00m0*m0*m0TEGChol |
| hsa-miR-521 MIMAT0002854 | 5'Pm0000f0000f0005f05f00*0*5m0*5m0*5m0*0*0 | m0m0m0m0m0m0m0m0m0*m0*m0TEGChol |
| hsa-miR-522 MIMAT0002868 | 5'Pm00005f05f005f0f005f05f0f00*0*5m0*0*5m0*5m0*0 | m0m000m0m00m0m0m0m0*m0*m0TEGChol |
| hsa-miR-522* MIMAT0005451 | 5'Pm00005f05f000f05f005f0f05m0*0*5m0*5m0*f0*0*0 | m0m0m00m0m0m0m0m0m0*m0*m0TEGChol |
| hsa-miR-523 MIMAT0002840 | 5'Pm05f005f05f005f05f05f0000f00*5m0*0*5m0*f0*5m0*0 | m0m0m0m0m000m0m00m0*0*m0TEGChol |
| hsa-miR-523* MIMAT0005449 | 5'Pm05f000f0005f05f05f05f05f00*0*0*0*5m0*5m0*0 | m0m0000m00m0m0m0*0*m0TEGChol |
| hsa-miR-524-3p MIMAT0002850 | 5'Pm0005f05f005f05f05f00005f00*5m0*0*0*5m0*5m0*0 | m0m0m0m0m000m0m00*m0*m0TEGChol |
| hsa-miR-524-5p MIMAT0002849 | 5'Pm05f05f00f05f005f005f05f00*5m0*5*m0*0*f0*0*0 | m0m0m0m00m0m0m00*0*m0TEGChol |
| hsa-miR-525-3p MIMAT0002839 | 5'Pm0005f05f005f05f0f005f05f0f00*0*0*0*f0*5m0*0 | m0m000m0m000m0m0m0*m0*m0TEGChol |
| hsa-miR-525-5p MIMAT0002838 | 5'Pm0005f0f05f05f005f05f0f00*5m0*5m0*0*f0*0*0 | m0m0m00m0m000m0m0*m0*m0TEGChol |
| hsa-miR-526a MIMAT0002845 | 5'Pm05f05f00f005f00f0005f05f05m0*5m0*5m0*0*f0*0*0 | m0m0m0m0m0m0m0m00*0*m0TEGChol |
| hsa-miR-526b MIMAT0002835 | 5'Pm0005f05f05f05f0005f05f05f05f00f00*0*5m0*f0*5m0*0 | m0m000m0m0m0m000*m0*m0TEGChol |
| hsa-miR-526b* MIMAT0002836 | 5'Pm005f05f05f05f05f05f005f00f05m0*0*0*5m0*5m0*0 | m0m00m0m0000m000*m0*m0TEGChol |
| hsa-miR-527 MIMAT0002862 | 5'Pm0005f0f005f00f00005f05m0*5m0*0*5m0*5m0*5m0*0 | m0m0m0m0m0m0m00m0m00m0*m0*m0TEGChol |
| hsa-miR-532-3p MIMAT0004780 | 5'Pm0005f05f05f0000f005f05f0f00*0*5m0*5m0*5m0*0 | m0m000m0m000m0m0m0*m0*m0TEGChol |
| hsa-miR-532-5p MIMAT0002888 | 5'Pm005f005f05f000f05f05f00f00*0*0*0*f0*0*0 | m0m0m0m00m0m0m0m0m00*m0*m0TEGChol |

TABLE 5-continued

Examples of chemical modification patterns

| miRNA Name | Example of modified AS strand | Example of modified sense strand |
|---|---|---|
| hsa-miR-539 MIMAT0003163 | 5'Pm00005f05f005f05f05f05f005f00*0*0*0* 5m0*5m0*0 | m0m0m000m00m00m0m0m0*m0*m0TEGChol |
| hsa-miR-541 MIMAT0004920 | 5'Pm005f00f0000f00005f00*0*0*5m0*5m0* 5m0*0 | m0m0m0m0m0m0m0m0m0m0m00*m0*m0TEGChol |
| hsa-miR-541* MIMAT0004919 | 5'Pm005f005f00005f05f05f0f00*0*0*0*f0 *0*0 | m0m0000m0m0m0m0m0m0m00*m0*m0TEGChol |
| hsa-miR-542-3p MIMAT0003389 | 5'Pm00005f05f05f05f0f05f05f05f05m0*5 m0*5m0*0*f0*0 | m0m0000m0000m0m0m0*m0*m0TEGChol |
| hsa-miR-542-5p MIMAT0003340 | 5'Pm0005f0f05f05f005f0f005f00*0*0*5m0* f0*5m0*0 | m0m00m0m0m0m00m0m0m0*m0*m0TEGChol |
| hsa-miR-543 MIMAT0004954 | 5'Pm05f05f00f0005f05f0005f05f5m0*5m0* 0*0*5m0*0 | m0m00m0m0m00m0m0m0m00*0*m0TEGChol |
| hsa-miR-544 MIMAT0003164 | 5'Pm0005f0f0000f0005f05f00*0*0*0*f0*0*0 | m0m00m0m0m0m0m0m0m0m00m0*m0*m0TEGChol |
| hsa-miR-544b MIMAT0015004 | 5'Pm005f05f0f0005f0f005f00f00*0*0*0*f0*0 | m0m00m0m00m0m0m0m000*m0*m0TEGChol |
| hsa-miR-545 MIMAT0003165 | 5'Pm0000f005f05f0f0000f00*5m0*0*0*f0*0 *0 | m0m0m0m0m0m0m0m0m0m0*m0*m0TEGChol |
| hsa-miR-545* MIMAT0004785 | 5'Pm05f000f0000f00005f00*0*5m0*5m0*5 m0*5m0*0 | m0m0m0m0m0m0m0m0m0m0m0*0*m0TEGChol |
| hsa-miR-548a-3p MIMAT0003251 | 5'Pm0000f05f0005f05f005f0f00*5m0*5m0*5 m0*5m0*5m0*0 | m0m0m0m0m0m0m0m0m0m0*m0*m0TEGChol |
| hsa-miR-548a-5p MIMAT0004803 | 5'Pm0000f005f05f0f05f0005f05m0*5m0*5 m0*5m0*5m0*0 | m0m00m0m00m000m0m0m0*m0*m0TEGChol |
| hsa-miR-548aa MIMAT0018447 | 5'Pm05f05f005f0000f00005f00*5m0*5m0*0 *5m0** | m0m00m0m0m00m0m0m0m0m00*0*m0TEGChol |
| hsa-miR-548b-3p MIMAT0003254 | 5'Pm05f0005f005f05f05f005f005m0*5m0 *5m0**** | m0m00m0m00m000m0m0m0*0*m0TEGChol |
| hsa-miR-548b-5p MIMAT0004798 | 5'Pm0000f05f0005f05f05f00*5m0*5m0* 5m0*5m0*5m0*0 | m0m00m0m00m0m0m0m0m0m0*m0*m0TEGChol |
| hsa-miR-548c-3p MIMAT0003285 | 5'Pm0000f0000f05f05f00f00*5m0*0*5m0*f0 ** | m0m000m0m0m0m0m0m0m0*m0*m0TEGChol |
| hsa-miR-548c-5p MIMAT0004806 | 5'Pm0000f005f05f0f05f0005f05m0*0*5m0*5 m0*5m0*5m0*0 | m0m00m0m00m000m0m0m0*m0*m0TEGChol |
| hsa-miR-548d-3p MIMAT0003323 | 5'Pm0005f0f005f05f0f05f000f05m0*0*0*5 m0*5m0*0 | m0m00m0m00m000m0m0m0*m0*m0TEGChol |
| hsa-miR-548d-5p MIMAT0004812 | 5'Pm005f005f05f05f00f0000f00*5m0*0*0*f0 *0*0 | m0m0m0m0m0m0m000m00*m0*m0TEGChol |
| hsa-miR-548e MIMAT0005874 | 5'Pm0000f05f005f05f05f05f05f05m0*5m0 *5m0*5m0*f0*5m0*0 | m0m0000m00m00m0m0*m0*m0TEGChol |
| hsa-miR-548f MIMAT0005895 | 5'Pm05f05f005f0000f00005f00*5m0*5m0*0 *5m0*5m0*0 | m0m0m0m0m0m0m0m0m0m00*0*m0TEGChol |
| hsa-miR-548g MIMAT0005912 | 5'Pm0000f0000f00005f00*0*5m0*5m0*f0*0 *0 | m0m0m0m0m0m0m0m0m0m0m0*m0*m0TEG Chol |
| hsa-miR-548h MIMAT0005928 | 5'Pm005f05f05f05f005f05f05f05f05f05m0 *0*0*0*5m0*0*0 | m0m0000m00m00m000*m0*m0TEGChol |
| hsa-miR-548i MIMAT0005935 | 5'Pm05f05f05f0f05f05f05f05f05f0f00* 0*5m0*0*5m0*5m0*0 | m0m0000m0000m000*0*m0TEGChol |
| hsa-miR-548j MIMAT0005875 | 5'Pm05f0005f05f05f005f05f05f05f00*0*5 m0*5m0*5m0*5m0*0 | m0m000m0m000m0m0m0*0*m0TEGChol |
| hsa-miR-548k MIMAT0005882 | 5'Pm005f05f05f05f005f05f05f05f0f05m0* 5m0*5m0*5m0*5m0*0* | m0m0000m00m00m000*m0*m0TEGChol |
| hsa-miR-548l MIMAT0005889 | 5'Pm005f05f05f05f05f05f005f05f05f05m0* 0*0*5m0*5m0*0 | m0m000m0m0000m000*m0*m0TEGChol |
| hsa-miR-548m MIMAT0005917 | 5'Pm05f05f05f05f0000f00005f00*5m0*5m0* 0*5m0*5m0*0 | m0m0m0m0m0m0m0m0m0m000*0*m0TEGChol |
| hsa-miR-548n MIMAT0005916 | 5'Pm0005f0f05f05f05f0f05f05f05f05m0*0 *5m0*5m0*f0*0*0 | m0m0m0m0000m0m0*m0*m0TEGChol |
| hsa-miR-548o MIMAT0005919 | 5'Pm05f05f05f05f0f0000f005f00f00*0*5m0*f 0** | m0m0m0m0m0m0m0m0m0m000*0*m0TEGChol |
| hsa-miR-548p MIMAT0005934 | 5'Pm05f05f00f005f05f05f00005f05m0*5m0* 5m0*5m0*5m0*5m0*0 | m0m00m0m00m0m0m0m0m0m0*0*m0TEGChol |
| hsa-miR-548q MIMAT0011163 | 5'Pm05f05f00f05f005f05f05f05f05f0f05m0*0 *0*0*5m0*0*0 | m0m0000m0m00m00m00*0*m0TEGChol |
| hsa-miR-548s MIMAT0014987 | 5'Pm05f05f05f0f0005f05f00005f00*0*0*5m0 *f0*0*0 | m0m00m0m0m0m0m0m0m00*0*m0TEGChol |
| hsa-miR-548t MIMAT0015009 | 5'Pm0000f05f05f05f0f0005f05f0005f00*5m0*5m 0*5m0*f0*0*0 | m0m0m0m0m0m0m0000m0m0*m0*m0TEGChol |
| hsa-miR-548u MIMAT0015013 | 5'Pm05f0005f05f05f005f05f05f05f00*0*5m 0*5m0*5m0*5m0*0 | m0m000m0m0m0m0m0m0m0*0*m0TEGChol |
| hsa-miR-548v MIMAT0015020 | 5'Pm005f05f0f05f005f05f05f05f05f05m0* 5m0*0*f0*0*0 | m0m000m0m0m0m0m0m000*m0*m0TEGChol |
| hsa-miR-548w MIMAT0015060 | 5'Pm00005f05f000f05f005f0f00*0*5m0*0*f0 *0*0 | m0m0m0m0m0m0m0m0m0*m0*m0TEGChol |
| hsa-miR-548x MIMAT0015081 | 5'Pm005f00f005f00f05f05f00f05m0*5m0*0* 0*f0*5m0*0 | m0m0m0m0m0m0m0m0m00*m0*m0TEGChol |

TABLE 5-continued

Examples of chemical modification patterns

| miRNA Name | Example of modified AS strand | Example of modified sense strand |
|---|---|---|
| hsa-miR-548y MIMAT0018354 | 5'Pm05f05f00f05f005f05f05f05f05f05m0*0*0*0*5m0*0*0 | m0m0000m00m00m0m00*0*m0TEGChol |
| hsa-miR-548z MIMAT0018446 | 5'Pm00005f0005f0f00005f05m0*5m0*5m0*0*5m0*5m0*0 | m0m0m0m0m0m0m0m0m0m0m0*m0*m0TEGChol |
| hsa-miR-549 MIMAT0003333 | 5'Pm05f05f05f05f0000f0000f00*0*5m0*0*f0*5m0*0 | m0m0m0m0m0m0m0m0m000*0*m0TEGChol |
| hsa-miR-550a MIMAT0004800 | 5'Pm05f05f00f05f05f05f05f0005f05m0*0*0*5m0*5m0*0 | m0m00m0m0m0000m0m00*0*m0TEGChol |
| hsa-miR-550a* MIMAT0003257 | 5'Pm05f005f0f005f05f05f05f005f0f05m0*0*0*5m0*f0*5m0*0 | m0m00m00m000m00m00*0*m0TEGChol |
| hsa-miR-550b MIMAT0018445 | 5'Pm05f000f05f005f05f05f000f05m0*5m0*5m0*5m0*5m0*0*0 | m0m0m0m00m00m00m0m0*0*m0TEGChol |
| hsa-miR-551a MIMAT0003214 | 5'Pm05f05f00f05f005f05f05f0005f00*0*0*5m0*f0*5m0*0 | m0m00m00m00m00m00*0*m0TEGChol |
| hsa-miR-551b MIMAT0003233 | 5'Pm05f05f00f05f0005f0005f0f00*0*0*5m0*5m0*5m0*0 | m0m0m0m0m0m0m0m00*0*m0TEGChol |
| hsa-miR-551b* MIMAT0004794 | 5'Pm00005f00005f05f000f05m0*5m0*5m0*5m0*5m0*0*0 | m0m00m00m0m0m0m0m0m0m0*m0*m0TEGChol |
| hsa-miR-552 MIMAT0003215 | 5'Pm0005f0f05f05f05f05f05f05f05f05m0*0*0*0*f0*5m0*0 | m0m0000m0000m00m0*m0*m0TEGChol |
| hsa-miR-553 MIMAT0003216 | 5'Pm05f05f00f05f05f05f0f0000f00*0*0*5m0*5m0*5m0*0 | m0m0m0m0m0000m0m00*0*m0TEGChol |
| hsa-miR-554 MIMAT0003217 | 5'Pm005f05f0f005f005f05f05f0f00*0*5m0*5m0*f0*0*0 | m0m00m00m0m0m0m00*m0*m0TEGChol |
| hsa-miR-555 MIMAT0003219 | 5'Pm005f05f0f05f05f00f0000f05m0*5m0*5m0*5m0*0*f0*0*0 | m0m0m0m0m0m000m0*m0*m0TEGChol |
| hsa-miR-556-3p MIMAT0004793 | 5'Pm0005f05f05f05f00f005f05f05f00*5m0*5m0*f0*5m0*0 | m0m000m0m000m00m0*m0*m0TEGChol |
| hsa-miR-556-5p MIMAT0003220 | 5'Pm0000f0000f05f05f00f05m0*0*5m0*0*5m0*0*0 | m0m0m000m0m0m0m0m0m0*m0*m0TEGChol |
| hsa-miR-557 MIMAT0003221 | 5'Pm05f05f05f05f05f000f05f005f0f00*5m0*5m0*5m0*5m0*0 | m0m00m00m00m00m000*0*m0TEGChol |
| hsa-miR-558 MIMAT0003222 | 5'Pm0005f05f05f05f05f0f0005f05f05m0*5m0*0*0*5m0*0*0 | m0m00m0m0m0000m0m0*m0*m0TEGChol |
| hsa-miR-559 MIMAT0003223 | 5'Pm05f05f05f0f00005f05f05f05f05m0*0*0*5m0*f0*0*0 | m0m0000m0m0m0m00m00*0*m0TEGChol |
| hsa-miR-561 MIMAT0003225 | 5'Pm05f005f05f005f05f0f05f00f05m0*5m0*5m0*0*5m0*5m0*0 | m0m000m000m0m0m0m0*0*m0TEGChol |
| hsa-miR-562 MIMAT0003226 | 5'Pm05f005f05f05f05f05f00005f05m0*0*0*0*5m0** | m0m0m0m0000m00m0*0*m0TEGChol |
| hsa-miR-563 MIMAT0003227 | 5'Pm05f000f005f05f0f05f000f05m0*0*0*f0*0*0 | m0m0m00m000m0m0m0*0*m0TEGChol |
| hsa-miR-564 MIMAT0003228 | 5'Pm005f00f0005f05f0005f05f00*0*5m0*0*** | m0m0m0m00m0m0m00m00*m0*m0TEGChol |
| hsa-miR-566 MIMAT0003230 | 5'Pm05f005f05f05f000f05f05f05f00*0*0*5m0*5m0*0 | m0m0000m0m0m00m00*0*m0TEGChol |
| hsa-miR-567 MIMAT0003231 | 5'Pm005f00f05f0005f0005f0f00*5m0*0*0*f0*5m0*0 | m0m0m0m00m0m0m00m00*m0*m0TEGChol |
| hsa-miR-568 MIMAT0003232 | 5'Pm05f000f00005f0000f00*0*5m0*5m0*5m0*0*0 | m0m0m0m0m0m0m0m0m0m0*0*m0TEGChol |
| hsa-miR-569 MIMAT0003234 | 5'Pm05f05f05f05f05f0005f05f05f05f05m0*0*5m0*0*f0*5m0*0 | m0m0000m0m00m000*0*m0TEGChol |
| hsa-miR-570 MIMAT0003235 | 5'Pm005f05f05f005f05f0f05f05f05m0*5m0*0*0*f0*0*0 | m0m00m00m000m0m000*m0*m0TEGChol |
| hsa-miR-571 MIMAT0003236 | 5'Pm05f005f05f0000f05f05f05f05m0*0*0*f0*0*0 | m0m0000m0m0m0m00m00*0*m0TEGChol |
| hsa-miR-572 MIMAT0003237 | 5'Pm05f05f00f05f05f05f05f05f05f05m0*5m0*5m0*5m0*5m0** | m0m00m00m00m0m00*0*m0TEGChol |
| hsa-miR-573 MIMAT0003238 | 5'Pm05f05f05f05f00f0000f00*0*5m0*0*5m0*5m0*0 | m0m0m0m0m0m0m0m00m000*0*m0TEGChol |
| hsa-miR-574-3p MIMAT0003239 | 5'Pm05f05f005f005f00f005f005f00*5m0*0*5m0*f0*5m0*0 | m0m00m00m0m0m0m0m0m00*0*m0TEGChol |
| hsa-miR-574-5p MIMAT0004795 | 5'Pm005f05f05f05f05f05f05f05f00f00*0*0*5m0** | m0m0m0m0000m0m000*m0*m0TEGChol |
| hsa-miR-575 MIMAT0003240 | 5'Pm05f05f05f05f0000f0000f00*0*0*5m0*f0*5m0*0 | m0m0m0m0m0m0m0m0m0m000*0*m0TEGChol |
| hsa-miR-576-3p MIMAT0004796 | 5'Pm005f05f0f005f00f005f05f05f05m0*0*0*0*f0*0*0 | m0m000m0m0m00m0m000*m0*m0TEGChol |
| hsa-miR-576-5p MIMAT0003241 | 5'Pm05f000f05f005f05f000f05m0*0*5m0*5m0*0*0 | m0m00m00m00m00m0m0m00*0*m0TEGChol |
| hsa-miR-577 MIMAT0003242 | 5'Pm0005f05f05f05f05f05f05f05f00*0*0*f0*5m0*0 | m0m000m0m0000m0m0*m0*m0TEGChol |
| hsa-miR-578 MIMAT0003243 | 5'Pm005f05f005f05f05f00005f00*0*0*5m0*f0*0*0 | m0m0m0m0m00m00m00*0*m0TEGChol |
| hsa-miR-579 MIMAT0003244 | 5'Pm05f05f05f0f005f05f005f00f05m0*0*0*5m0*0*f0*0*0 | m0m0m0m00m0m0m0m000*0*m0TEGChol |

TABLE 5-continued

Examples of chemical modification patterns

| miRNA Name | Example of modified AS strand | Example of modified sense strand |
|---|---|---|
| hsa-miR-580 MIMAT0003245 | 5'Pm005f05f05f00005f05f05f05f05f00*0*5m0*5m0*5m0*0 | m0m0000m0m0m0m0m000*m0*m0TEGChol |
| hsa-miR-581 MIMAT0003246 | 5'Pm0000f05f05f005f0f005f00f05m0*0*0*5m0*f0*5m0*0 | m0m0m00m0m00m00m0m0m0*m0*m0TEGChol |
| hsa-miR-582-3p MIMAT0004797 | 5'Pm05f05f05f0f0000f05f000f00*0*0*5m0*f0*5m0*0 | m0m0m0m0m0m0m0m0m000*0*m0TEGChol |
| hsa-miR-582-5p MIMAT0003247 | 5'Pm005f05f0f05f005f05f05f0005f05m0*0*5m0*5m0*f0*0 | m0m0m0m00m00m00m000*m0*m0TEGChol |
| hsa-miR-583 MIMAT0003248 | 5'Pm05f05f00f05f005f05f0005f0f05m0*0*5m0*5m0*5m0*5m0*0 | m0m00m0m0m0m0m00m00*0*m0TEGChol |
| hsa-miR-584 MIMAT0003249 | 5'Pm0000f05f0005f00005f05m0*0*0*5m0** | m0m0m0m0m0m0m00m0m0m0*m0*m0TEGChol |
| hsa-miR-585 MIMAT0003250 | 5'Pm05f05f00f05f05f005f05f05f0f00*5m0*5m0*5m0*5m0*5m0*0 | m0m0000m0m000m0m00*0*m0TEGChol |
| hsa-miR-586 MIMAT0003252 | 5'Pm05f05f00f05f0005f0005f00*5m0*0*0*f0*5m0*0 | m0m0m00m0m0m00m0m00*0*m0TEGChol |
| hsa-miR-587 MIMAT0003253 | 5'Pm05f000f0000f05f05f05f05f05m0*0*0*0*f0*5m0*0 | m0m0000m0m0m0m0m0m0*0*m0TEGChol |
| hsa-miR-588 MIMAT0003255 | 5'Pm05f005f05f005f05f0f0000f00*5m0*5m0*5m0*** | m0m0m0m0m000m0m00m0*0*m0TEGChol |
| hsa-miR-589 MIMAT0004799 | 5'Pm005f05f0f05f000f05f005f0f05m0*0*5m0*5m0*** | m0m0m00m0m0m0m00m000*m0*m0TEGChol |
| hsa-miR-589* MIMAT0003256 | 5'Pm005f00f005f05f005f05f0f05m0*0*0*5m0*f0*5m0*0 | m0m0000m0m000m0m00*m0*m0TEGChol |
| hsa-miR-590-3p MIMAT0004801 | 5'Pm0000f00005f05f005f05f00*0*0*5m0*5m0*0 | m0m00m00m0m0m0m0m0m0*m0*m0TEGChol |
| hsa-miR-590-5p MIMAT0003258 | 5'Pm005f05f0f005f05f005f05f0f00*0*5m0*0*5m0*5m0*0 | m0m0m0m000m0m000*m0*m0TEGChol |
| hsa-miR-591 MIMAT0003259 | 5'Pm0000f005f005f05f05f05f05m0*0*0*5m0*f0*5m0*0 | m0m0000m0m00m0m0m0*m0*m0TEGChol |
| hsa-miR-592 MIMAT0003260 | 5'Pm005f00f0005f0f005f00f00*0*5m0*5m0*f0*0*0 | m0m00m0m00m0m0m0m00*m0*m0TEGChol |
| hsa-miR-593 MIMAT0004802 | 5'Pm005f005f005f05f05f0005f0f00*0*5m0*5m0*f0*0*0 | m0m00m0m000m0m00*m0*m0TEGChol |
| hsa-miR-593* MIMAT0003261 | 5'Pm05f05f05f05f00005f0000f05m0*5m0*0*5m0*** | m0m0m0m0m0m0m0m0m000*0*m0TEGChol |
| hsa-miR-595 MIMAT0003263 | 5'Pm05f05f05f0f00005f00005f05m0*0*5m0*5m0*f0*0*0 | m0m0m0m0m0m0m0m0m000*0*m0TEGChol |
| hsa-miR-596 MIMAT0003264 | 5'Pm00005f05f005f05f0005f0f00*5m0*5m0*5m0*5m0*0*0 | m0m0m00m0m00m0m0m0*m0*m0TEGChol |
| hsa-miR-597 MIMAT0003265 | 5'Pm005f005f05f000f005f00f00*0*5m0*f0*0*0 | m0m00m0m0m0m00m0m00*m0*m0TEGChol |
| hsa-miR-598 MIMAT0003266 | 5'Pm005f00f05f005f0005f0f00*0*5m0*5m0*5m0*0 | m0m0m0m00m00m0m00*m0*m0TEGChol |
| hsa-miR-599 MIMAT0003267 | 5'Pm05f000f05f05f005f05f000f00*0*5m0*5m0*0*0 | m0m0m00m0m000m0m0m0*0*m0TEGChol |
| hsa-miR-600 MIMAT0003268 | 5'Pm05f000f05f0005f05f05f05f05m0*5m0*0*5m0*f0*5m0*0 | m0m0000m0m00m0m0m0*0*m0TEGChol |
| hsa-miR-601 MIMAT0003269 | 5'Pm05f05f05f05f00005f005f05f0f05m0*0*5m0*0*5m0*5m0*0 | m0m000m0m0m0m0m000*0*m0TEGChol |
| hsa-miR-602 MIMAT0003270 | 5'Pm05f05f05f0f05f005f0005f0f00*0*5m0*5m0*5m0*5m0*0 | m0m0m0m0m0m0m0m000*0*m0TEGChol |
| hsa-miR-603 MIMAT0003271 | 5'Pm05f000f005f005f05f05f05f0*5m0*0*0*5m0*0*0 | m0m000m0m0m0m0m0m0*0*m0TEGChol |
| hsa-miR-604 MIMAT0003272 | 5'Pm00005f05f05f05f0f05f0005f05m0*5m0*5m0*5m0*5m0*** | m0m0m00m0m000m0m0*m0*m0TEGChol |
| hsa-miR-605 MIMAT0003273 | 5'Pm05f05f00f05f05f05f0005f05f05m0*0*0*5m0*5m0*5m0*0 | m0m00m0m0m0000m0m00*0*m0TEGChol |
| hsa-miR-606 MIMAT0003274 | 5'Pm005f05f05f05f05f05f05f05f00f00*0*0*5m0*** | m0m0m000m0000m000*m0*m0TEGChol |
| hsa-miR-607 MIMAT0003275 | 5'Pm0000f00005f00005f00*0*0*f0*5m0*0 | m0m0m0m0m0m0m0m0m0m0m0*m0*m0TEGChol |
| hsa-miR-608 MIMAT0003276 | 5'Pm00005f05f005f05f005f005f05m0*0*0*f0*5m0* | m0m0m00m0m00m0m0m0m0*m0*m0TEGChol |
| hsa-miR-609 MIMAT0003277 | 5'Pm05f05f005f05f05f0f05f0005f05m0*5m0*0*f0*0*0 | m0m0m0m0m0000m0m00*0*m0TEGChol |
| hsa-miR-610 MIMAT0003278 | 5'Pm05f05f05f05f00005f0000f00*5m0*0*5m0*5m0*0*0 | m0m0m0m0m0m0m0m0m000*0*m0TEGChol |
| hsa-miR-611 MIMAT0003279 | 5'Pm0000f0000f0005f05f00*0*0*f0*5m0*0 | m0m0m0m0m0m0m0m0m0m0*m0*m0TEGChol |
| hsa-miR-612 MIMAT0003280 | 5'Pm05f0005f0005f0f0005f05f00*5m0*5m0*5m0*5m0*0*0 | m0m0m0m0m0m0m0m0m0*0*m0TEGChol |
| hsa-miR-613 MIMAT0003281 | 5'Pm00005f0005f0f05f05f05f05f00*0*5m0*0*f0*5m0*0 | m0m000m00m0m0m0m00*m0*m0TEGChol |
| hsa-miR-614 MIMAT0003282 | 5'Pm05f05f005f05f05f05f0f05f0005f00*5m0*5m0*0*f0*0*0 | m0m0m0m00m0000m0m00*0*m0TEGChol |

TABLE 5-continued

Examples of chemical modification patterns

| miRNA Name | Example of modified AS strand | Example of modified sense strand |
|---|---|---|
| hsa-miR-615-3p MIMAT0003283 | 5'Pm0000f05f005f0f005f05f0f05m0*0*0*0*f0*5m0*0 | m0m000m0m00m00m0m0m0*m0*m0TEGChol |
| hsa-miR-615-5p MIMAT0004804 | 5'Pm005f05f0f005f00f05f005f05f00*0*0*5m0*5m0*0 | m0m00m0m0m0m00m0m0m0*m0*m0TEGChol |
| hsa-miR-616 MIMAT0004805 | 5'Pm05f05f005f005f005f05f05f05f05m0*5m0*0*0*f0*0*0 | m0m0000m0m00m00m00*0*m0TEGChol |
| hsa-miR-616* MIMAT0003284 | 5'Pm0000f05f005f0f005f05f05f05m0*0*5m0*5m0*f0*0*0 | m0m000m0m00m00m0m0m0*m0*m0TEGChol |
| hsa-miR-617 MIMAT0003286 | 5'Pm0005f0f005f00f0005f0f00*0*0*5m0*5m0*5m0*0 | m0m00m0m0m00m0m00m0*m0*m0TEGChol |
| hsa-miR-618 MIMAT0003287 | 5'Pm05f05f005f0005f0f05f005f0f05m0*0*5m0*5m0*5m0*5m0*0 | m0m00m00m0m0m0m0m00*0*m0TEGChol |
| hsa-miR-619 MIMAT0003288 | 5'Pm005f05f05f005f005f05f0f05f00*0*0*f0*0*0 | m0m0m00m0m00m0m00m000*m0*m0TEGChol |
| hsa-miR-620 MIMAT0003289 | 5'Pm0005f05f05f005f05f05f005f05m0*5m0*5m0*5m0*5m0*5m0*0 | m0m000m0m00m00m00m0*m0*m0TEGChol |
| hsa-miR-621 MIMAT0003290 | 5'Pm05f005f0f05f005f05f05f05f05f05f05m0*0*0*0*f0*5m0*0 | m0m0000m00m00m00m0*0*m0TEGChol |
| hsa-miR-622 MIMAT0003291 | 5'Pm05f0005f00005f00005f05m0*0*0*5m0*f0*5m0*0 | m0m0m0m0m0m0m0m0m0m0m0*0*m0TEGChol |
| hsa-miR-623 MIMAT0003292 | 5'Pm05f05f005f00005f005f05f0f00*0*0*5m0*0*0 | m0m000m0m0m0m0m0m0m00*m0*m0TEGChol |
| hsa-miR-624 MIMAT0004807 | 5'Pm05f05f005f005f005f05f05f05f05f05m0*5m0*0*0*f0*0*0 | m0m0000m0m00m0m00*0*m0TEGChol |
| hsa-miR-624* MIMAT0003293 | 5'Pm05f005f05f05f005f0005f05f05f05m0*0*5m0*0*5m0*5m0*0 | m0m000m0m000m0m0m0*m0*m0TEGChol |
| hsa-miR-625 MIMAT0003294 | 5'Pm05f05f05f0f05f005f005f00f05m0*5m0*5m0*0*f0*5m0*0 | m0m00m0m00m00m000*0*m0TEGChol |
| hsa-miR-625* MIMAT0004808 | 5'Pm05f00f005f05f0f00005f05m0*5m0*0*5m0*f0*0*0 | m0m0m0m0m0m0m0m0m0m00*m0*m0TEGChol |
| hsa-miR-626 MIMAT0003295 | 5'Pm05f005f0f05f005f0f05f005f0f00*5m0*5m0*0*5m0*5m0*0 | m0m00m0m00m00m00*0*m0TEGChol |
| hsa-miR-627 MIMAT0003296 | 5'Pm05f005f05f05f0005f005f05f05m0*0*5m0*0*5m0*0 | m0m0000m0m00m0m0m0*0*m0TEGChol |
| hsa-miR-628-3p MIMAT0003297 | 5'Pm0000f05f000f05f005f0f05m0*0*5m0*5m0*f0*0*0 | m0m00m00m0m00m0m0m0*m0*m0TEGChol |
| hsa-miR-628-5p MIMAT0004809 | 5'Pm0005f0f005f005f05f05f0f0m0*5m0*5m0*0*f0*5m0*0 | m0m0000m0m00m0m0m0*m0*m0TEGChol |
| hsa-miR-629 MIMAT0004810 | 5'Pm00005f005f00f00005f05m0*5m0*0*0*f0*5m0*0 | m0m0m0m0m0m0m0m0m0m0*m0*m0TEGChol |
| hsa-miR-629* MIMAT0003298 | 5'Pm005f00f05f000f005f00f00*0*5m0*5m0*5m0*5m0*0 | m0m00m0m0m0m0m0m0m0*m0*m0TEGChol |
| hsa-miR-630 MIMAT0003299 | 5'Pm00005f0000f0005f05f00*0*5m0*0*f0*0*0 | m0m0m0m0m0m0m0m0m0*m0*m0TEGChol |
| hsa-miR-631 MIMAT0003300 | 5'Pm05f005f05f05f000f05f05f05f05f05m0*0*5m0*0*5m0*5m0*0 | m0m0000m0m00m00m0*0*m0TEGChol |
| hsa-miR-632 MIMAT0003302 | 5'Pm005f005f05f005f05f005f05f05f05m0*0*5m0*5m0*f0*0*0 | m0m00m0m00m00m00*m0*m0TEGChol |
| hsa-miR-633 MIMAT0003303 | 5'Pm05f000f05f05f05f005f00f05m0*0*0*0*f0*0*0 | m0m00m0m00m0000m0m0*0*m0TEGChol |
| hsa-miR-634 MIMAT0003304 | 5'Pm005f005f00005f05f000f05m0*0*5m0*5m0*m0*f0*5m0*0 | m0m00m00m0m0m0m0m00*m0*m0TEGChol |
| hsa-miR-635 MIMAT0003305 | 5'Pm0005f0f05f000f00005f05m0*0*0*0*5m0*0*0 | m0m0m0m0m0m0m00m00m0*m0*m0TEGChol |
| hsa-miR-636 MIMAT0003306 | 5'Pm005f05f0f05f000f005f00f00*0*5m0*5m0*f0*5m0*0 | m0m00m0m0m00m0m000*m0*m0TEGChol |
| hsa-miR-637 MIMAT0003307 | 5'Pm0000f05f05f05f0f0000f05m0*0*0*0*f0*0*0 | m0m0m0m0m0m0000m0m0*m0*m0TEGChol |
| hsa-miR-638 MIMAT0003308 | 5'Pm005f05f05f00005f005f05f05m0*5m0*0*5m0*f0*5m0*0 | m0m00m0m0m0m0m000*m0*m0TEGChol |
| hsa-miR-639 MIMAT0003309 | 5'Pm0000f0000f00005f00*0*5m0*5m0*5m0*5m0*0 | m0m0m0m0m0m0m0m0m0m0m0*m0*m0TEGChol |
| hsa-miR-640 MIMAT0003310 | 5'Pm05f005f0f0005f05f05f0005f00*5m0*0*5m0*f0*0*0 | m0m00m0m0m0m0m00m00*0*m0TEGChol |
| hsa-miR-641 MIMAT0003311 | 5'Pm05f000f0005f05f05f005f0f00*0*5m0*5m0*5m0*5m0*0 | m0m00m0m0m0m0m0m0m0*0*m0TEGChol |
| hsa-miR-642a MIMAT0003312 | 5'Pm05f05f05f05f0f05f05f05f05f05f05f05f05m0*5m0*5m0*5m0*5m0*5m0*0 | m0m0000m0000m000*0*m0TEGChol |
| hsa-miR-642b MIMAT0018444 | 5'Pm0005f05f05f05f005f0005f05m0*5m0*0*0*f0** | m0m000m0m00m00m00m0*m0*m0TEGChol |
| hsa-miR-643 MIMAT0003313 | 5'Pm0000f05f05f00f05f05f05f05m0*5m0*5m0*5m0*5m0*0*0 | m0m0000m0m000m0m0m0*0*m0TEGChol |
| hsa-miR-644 MIMAT0003314 | 5'Pm0005f0f005f05f05f005f05f05m0*5m0*0*5m0*f0*0*0 | m0m000m0m00m0m00m0*m0*m0TEGChol |
| hsa-miR-645 MIMAT0003315 | 5'Pm005f005f05f05f005f05f05f00*0*0*f0*5m0*0 | m0m000m0m00m0m0m0*m0*m0TEGChol |

TABLE 5-continued

Examples of chemical modification patterns

| miRNA Name | Example of modified AS strand | Example of modified sense strand |
|---|---|---|
| hsa-miR-646 MIMAT0003316 | 5'Pm0000f05f0005f005f005f00*5m0*5m0*0*5m0*5m0*0 | m0m0m00m0m0m0m0m00m0m0m0*m0*m0TEGChol |
| hsa-miR-647 MIMAT0003317 | 5'Pm0000f0005f05f05f05f05f05m0*5m0*5m0*5m0*f0*0*0 | m0m0000m00m0m0m0m0m0*m0*m0TEGChol |
| hsa-miR-648 MIMAT0003318 | 5'Pm05f000f0005f05f0005f0f05m0*0*0*0*f0*0*0 | m0m00m0m0m0m0m0m0m0*0*m0TEGChol |
| hsa-miR-649 MIMAT0003319 | 5'Pm05f05f005f05f05f05f005f05f0f05m0*5m0*5m0*0*f0*0*0 | m0m000m0m0000m0m00*0*m0TEGChol |
| hsa-miR-650 MIMAT0003320 | 5'Pm0000f05f05f05f0f00005f05m0*5m0*5m0*5m0*f0*0*0 | m0m0m0m0m0000m0m0m0*m0*m0TEGChol |
| hsa-miR-651 MIMAT0003321 | 5'Pm05f05f05f0f00005f05f05f05f0f00*5m0*5m0*5m0*5m0*0*0 | m0m0000m0m0m0m0m00*0*m0TEGChol |
| hsa-miR-652 MIMAT0003322 | 5'Pm005f05f05f05f05f00f0005f05m0*0*0*0*5m0*0*0 | m0m00m0m0m000m000*m0*m0TEGChol |
| hsa-miR-653 MIMAT0003328 | 5'Pm05f005f0f05f05f05f0f05f05f05f00*0*5m0*0*f0** | m0m0000m0000m00m0*0*m0TEGChol |
| hsa-miR-654-3p MIMAT0004814 | 5'Pm05f05f05f05f05f000f05f005f0f00*5m0*0*0*f0*5m0*0 | m0m00m0m0m0m00m000*0*m0TEGChol |
| hsa-miR-654-5p MIMAT0003330 | 5'Pm00005f0005f05f005f05m0*0*5m0*5m0*5m0*0*0 | m0m0m00m0m00m0m0m0m0*m0*m0TEGChol |
| hsa-miR-655 MIMAT0003331 | 5'Pm0000f0005f05f0000f00*5m0*0*0*f0*0*0 | m0m0m0m00m0m0m0m0m0m0m0*m0*m0TEGChol |
| hsa-miR-656 MIMAT0003332 | 5'Pm005f05f0f05f005f0f005f005f05m0*5m0*0*5m0*5m0*5m0*0 | m0m00m0m0m00m00m000*m0*m0TEGChol |
| hsa-miR-657 MIMAT0003335 | 5'Pm05f05f005f005f05f0f05f05f00f00*0*0*5m0*5m0*5m0*0 | m0m0m000m0m0m0m0m00*0*m0TEGChol |
| hsa-miR-658 MIMAT0003336 | 5'Pm00005f0000f05f05f05f05m0*0*5m0*5m0*5m0*5m0*0 | m0m0000m0m0m0m0m0m0*m0*m0TEGChol |
| hsa-miR-659 MIMAT0003337 | 5'Pm005f05f05f05f05f05f05f005f05f05m0*5m0*5m0*0*f0*0*0 | m0m000m0m0000m000*m0*m0TEGChol |
| hsa-miR-660 MIMAT0003338 | 5'Pm05f05f05f0f0000f05f000f05m0*5m0*5m0*5m0*5m0*5m0*0 | m0m0m0m00m0m0m0m0m000*0*m0TEGChol |
| hsa-miR-661 MIMAT0003324 | 5'Pm05f05f0f05f05f05f05f005f05m0*0*5m0*0*f0*5m0*0 | m0m00m0m0m0000m0m0*0*m0TEGChol |
| hsa-miR-662 MIMAT0003325 | 5'Pm005f05f0f05f0005f005f00f00*0*5m0*5m0*5m0*0*0 | m0m00m0m0m0m0m00m000*m0*m0TEGChol |
| hsa-miR-663 MIMAT0003326 | 5'Pm0000f05f005f05f05f05f05f05m0*5m0*5m0*0*5m0*5m0*0 | m0m0000m00m00m0m0m0*m0*m0TEGChol |
| hsa-miR-663b MIMAT0005867 | 5'Pm05f05f00f05f05f00f005f05f00*5m0*0*5m0*f0*0*0 | m0m0m0m0m000m0m0*0*m0TEGChol |
| hsa-miR-664 MIMAT0005949 | 5'Pm00005f00005f0000f00*0*0*0*5m0*0*0 | m0m0m0m0m0m0m0m0m0m0m0*m0*m0TEGChol |
| hsa-miR-664* MIMAT0005948 | 5'Pm0005f05f0005f0f05f005f0f05m0*5m0*5m0*5m0*5m0* | m0m00m0m00m0m0m0m0*m0*m0TEGChol |
| hsa-miR-665 MIMAT0004952 | 5'Pm0005f0f05f0005f005f0f00*5m0*0*0*f0*5m0* | m0m000m0m0m0m0m00m0*m0*m0TEGChol |
| hsa-miR-668 MIMAT0003881 | 5'Pm05f05f05f05f005f005f005f00f00*0*5m0*5m0*5m0*0*0 | m0m00m0m0m00m0m000*0*m0TEGChol |
| hsa-miR-670 MIMAT0010357 | 5'Pm005f05f05f05f05f05f05f005f0f00*5m0*0*0*f0*0*0 | m0m00m0m0m0000m000*m0*m0TEGChol |
| hsa-miR-671-3p MIMAT0004819 | 5'Pm00005f05f05f05f05f0000f00*5m0*0*0*f0*0*0 | m0m0m0m0m0000m0m0m0*m0*m0TEGChol |
| hsa-miR-671-5p MIMAT0003880 | 5'Pm0005f0f05f05f05f05f0005f05m0*5m0*5m0*0*f0*5m0* | m0m0m0m00m0000m0m0*m0*m0TEGChol |
| hsa-miR-675 MIMAT0004284 | 5'Pm0000f05f000f005f005f00*0*5m0*0*5m0*0*0 | m0m0m0m00m0m0m0m0m0*m0*m0TEGChol |
| hsa-miR-675* MIMAT0006790 | 5'Pm0005f05f05f05f0f00005f05m0*0*0*0*f0*5m0*0 | m0m0m0m0m00m00m0*m0*m0TEGChol |
| hsa-miR-676 MIMAT0018204 | 5'Pm0000f05f05f05f05f05f05f05f05m0*5m0*0*5m0*f0*0*0 | m0m0000m0000m0m0*m0*m0TEGChol |
| hsa-miR-676* MIMAT0018203 | 5'Pm0005f0f05f005f05f05f00f05m0*0*0*0*f0*0*0 | m0m000m0m0m0m00m0*m0*m0TEGChol |
| hsa-miR-7 MIMAT0000252 | 5'Pm0005f0f00005f005f0f05f0m0*0*0*0*f0*5m0*0 | m0m000m0m0m0m0m0m0*m0*m0TEGChol |
| hsa-miR-708 MIMAT0004926 | 5'Pm05f005f0f0000f0000f05m0*5m0*5m0*5m0*5m0*5m0*0 | m0m0m0m0m0m0m0m00m0*0*m0TEGChol |
| hsa-miR-708* MIMAT0004927 | 5'Pm005f05f05f005f005f0000f00*0*5m0*5m0*f0*0* | m0m0m0m0m0m0m0m000*m0*m0TEGChol |
| hsa-miR-7-1* MIMAT0004553 | 5'Pm0000f05f005f05f05f05f05f05m0*5m0*5m0*0*f0*0*0 | m0m00m0m00m0m0m0m0*m0*m0TEGChol |
| hsa-miR-711 MIMAT0012734 | 5'Pm005f00f05f05f05f0f005f05m0*0*5m0*5m0*5m0*0*0 | m0m0000m0m0m0m00*m0*m0TEGChol |
| hsa-miR-718 MIMAT0012735 | 5'Pm05f000f0005f05f05f000f00*0*0*5m0*f0*0* | m0m0m0m0m0m0m0m0*0*m0TEGChol |
| hsa-miR-7-2* MIMAT0004554 | 5'Pm0005f05f0000f0005f0f00*0*5m0*0*f0*0*0 | m0m00m0m0m0m0m0m0m00m0*m0*m0TEGChol |

TABLE 5-continued

Examples of chemical modification patterns

| miRNA Name | Example of modified AS strand | Example of modified sense strand |
|---|---|---|
| hsa-miR-720 MIMAT0005954 | 5'Pm05f05f005f005f05f0f05f05f00f00*0*5m0*5m0*0 | m0m0m000m000m0m0m00*0*m0TEGChol |
| hsa-miR-744 MIMAT0004945 | 5'Pm005f05f0f005f00f05f0005f00*5m0*5m0*5m0*f0*5m0*0 | m0m0m0m00m0m00m0m0m000*m0*m0TEGChol |
| hsa-miR-744* MIMAT0004946 | 5'Pm0000f05f005f0f05f05f05f05f00*5m0*0*5m0*f0*0*0 | m0m0000m00m00m0m0m0m0*m0*m0TEGChol |
| hsa-miR-758 MIMAT0003879 | 5'Pm00005f05f05f05f05f0005f0f05m0*0*5m0*5m0*f0*0*0 | m0m00m0m0m0000m0m0m0*m0*m0TEGChol |
| hsa-miR-759 MIMAT0010497 | 5'Pm05f0005f05f05f005f05f000f00*5m0*5m0*0*f0*0*0 | m0m00m00m0m000m0m0m0*0*m0TEGChol |
| hsa-miR-760 MIMAT0004957 | 5'Pm0000f05f05f005f00005f00*5m0*5m0*0*f0*5m0*0 | m0m0m0m0m0m000m0m0m0*m0*m0TEGChol |
| hsa-miR-761 MIMAT0010364 | 5'Pm005f05f05f005f05f05f05f05f05m0*5m0*0*5m0*5m0*0 | m0m000m0m000m0m000*m0*m0TEGChol |
| hsa-miR-762 MIMAT0010313 | 5'Pm005f005f05f05f05f05f05f05f00*0*0*0*5m0*0*0 | m0m0000m000m0m00*m0*m0TEGChol |
| hsa-miR-764 MIMAT0010367 | 5'Pm05f05f005f05f05f0f05f05f00f05m0*0*0*5m0*5m0*0*0 | m0m000m000m0m00m0m0*0*m0TEGChol |
| hsa-miR-765 MIMAT0003945 | 5'Pm00005f05f05f005f005f05f05f00*5m0*0*0*f0*5m0*0 | m0m000m0m0m000m0m0m0*m0*m0TEGChol |
| hsa-miR-766 MIMAT0003888 | 5'Pm05f005f05f05f000f05f05f0f05f00*0*0*0*f0*5m0*0 | m0m0000m00m0m0m0m0m0*0*m0TEGChol |
| hsa-miR-767-3p MIMAT0003883 | 5'Pm00005f00005f0000f00*0*0*0*5m0*0*0 | m0m0m0m0m0m0m0m0m0m0m0*m0*m0TEGChol |
| hsa-miR-767-5p MIMAT0003882 | 5'Pm00005f05f000f005f05f0f00*0*0*0*f0*5m0*0 | m0m000m0m0m00m0m0m0*m0*m0TEGChol |
| hsa-miR-769-3p MIMAT0003887 | 5'Pm00005f00005f05f005f0f00*5m0*0*5m0*f0*0*0 | m0m00m00m0m0m0m0m0m0*m0*m0TEGChol |
| hsa-miR-769-5p MIMAT0003886 | 5'Pm00005f00005f005f05f05f00*0*5m0*0*f0*0*0 | m0m000m0m0m0m0m0m0m0*m0*m0TEGChol |
| hsa-miR-770-5p MIMAT0003948 | 5'Pm05f0005f0000f005f00f00*0*0*5m0*5m0*5m0*0 | m0m00m00m0m0m0m0m0m0*0*m0TEGChol |
| hsa-miR-802 MIMAT0004185 | 5'Pm05f05f00f05f05f00f0f0000f00*0*5m0*0*f0*5m0*0 | m0m0m0m0m0m000m0m0*m0*m0TEGChol |
| hsa-miR-873 MIMAT0004953 | 5'Pm05f0005f05f05f05f05f05f00f00*0*5m0*5m0*** | m0m000m0000m0m0*0*m0TEGChol |
| hsa-miR-874 MIMAT0004911 | 5'Pm005f05f05f05f05f0f005f005f00*0*5m0*0*5m0*5m0*0 | m0m00m0m0000m000*m0*m0TEGChol |
| hsa-miR-875-3p MIMAT0004923 | 5'Pm05f05f00f0005f05f05f05f00f05m0*5m0*5m0*5m0*f0*5m0* | m0m000m00m0m0m00*0*m0TEGChol |
| hsa-miR-875-5p MIMAT0004922 | 5'Pm005f00f05f005f05f05f05f05f0f0*5m0*5m0*5m0*5m0*0*0 | m0m0000m00m00m0m00*m0*m0TEGChol |
| hsa-miR-876-3p MIMAT0004925 | 5'Pm05f05f005f0005f0f0005f05f05m0*5m0*5m0*f0*0*0 | m0m00m00m0m0m0m0m00*0*m0TEGChol |
| hsa-miR-876-5p MIMAT0004924 | 5'Pm05f05f005f05f05f05f0005f0f05m0*5m0*5m0*5m0*5m0*0 | m0m00m0m0m0000m0m0*0*m0TEGChol |
| hsa-miR-877 MIMAT0004949 | 5'Pm05f005f05f05f05f00f05f05f05f0f00*0*0*f0*5m0*0 | m0m0000m0m000m00m0*0*m0TEGChol |
| hsa-miR-877* MIMAT0004950 | 5'Pm00005f005f00f0000f00*5m0*5m0*0*f0*0*0 | m0m0m0m0m00m0m0m0m0*m0*m0TEGChol |
| hsa-miR-885-3p MIMAT0004948 | 5'Pm05f05f05f05f05f05f005f0000f00*5m0*5m0*0*5m0*5m0*0 | m0m0m0m0m0m0m000m000*0*m0TEGChol |
| hsa-miR-885-5p MIMAT0004947 | 5'Pm005f00f0005f0f0000f00*5m0*0*5m0*5m0*0*0 | m0m0m0m0m0m0m0m0m00*m0*m0TEGChol |
| hsa-miR-887 MIMAT0004951 | 5'Pm0000f05f005f05f05f05f05f05m0*5m0*5m0*0*f0*0*0 | m0m0000m00m0m0m0m0*m0*m0TEGChol |
| hsa-miR-888 MIMAT0004916 | 5'Pm05f05f05f05f0000f0000f00*5m0*0*5m0*5m0*5m0*0 | m0m0m0m0m0m0m0m000*0*m0TEGChol |
| hsa-miR-888* MIMAT0004917 | 5'Pm0000f05f000f005f005f05m0*0*5m0*0*f0*5m0*0 | m0m0m0m0m00m0m0m0*m0*m0TEGChol |
| hsa-miR-889 MIMAT0004921 | 5'Pm05f05f05f0f0005f05f0000f05m0*5m0*5m0*5m0*f0*5m0* | m0m0m0m0m0m0m000m000*0*m0TEGChol |
| hsa-miR-890 MIMAT0004912 | 5'Pm005f00f0005f05f05f05f00f05m0*0*5m0*5m0*f0*5m0*0 | m0m0m0m0m0m0m0m00m00*m0*m0TEGChol |
| hsa-miR-891a MIMAT0004902 | 5'Pm05f005f0f05f005f0f05f05f000f00*5m0*0*5m0*5m0*5m0*0 | m0m00m00m00m000m0m0*0*m0TEGChol |
| hsa-miR-891b MIMAT0004913 | 5'Pm0005f05f005f0005f05f05f05m0*0*0*0*f0*0*0 | m0m000m0m00m00m0m0*m0*m0TEGChol |
| hsa-miR-892a MIMAT0004907 | 5'Pm0005f0f05f05f00f05f05f05f05m0*0*5m0*5m0*0*0 | m0m000m000m0m0*m0*m0TEGChol |
| hsa-miR-892b MIMAT0004918 | 5'Pm005f00f005f05f00f05f000f05m0*5m0*5m0*5m0*f0*0*0 | m0m0m0m0m0m0m0m0m00*m0*m0TEGChol |
| hsa-miR-9 MIMAT0000441 | 5'Pm05f000f05f05f05f0f05f05f0f00*0*5m0*5m0*5m0*0*0 | m0m000m0000m0m0*0*m0TEGChol |
| hsa-miR-9* MIMAT0000442 | 5'Pm05f005f0f05f000f05f005f0f05m0*0*5m0*0*5m0*0*0 | m0m00m00m0m0m00m00*0*m0TEGChol |

TABLE 5-continued

Examples of chemical modification patterns

| miRNA Name | Example of modified AS strand | Example of modified sense strand |
|---|---|---|
| hsa-miR-920 MIMAT0004970 | 5'Pm05f05f00f0000f05f05f00f00*0*5m0*5m 0*5m0*5m0*0 | m0m0m000m0m0m0m0m0m00*0*m0TEGChol |
| hsa-miR-921 MIMAT0004971 | 5'Pm005f05f0f05f05f05f0f005f05f05f00*0*5 m0*5m0*5m0*0 | m0m000m0m0000m000*m0*m0TEGChol |
| hsa-miR-922 MIMAT0004972 | 5'Pm05f05f05f05f05f000f05f005f0f05m0*0*5 m0*0*f0*5m0*0 | m0m00m00m0m0m00m000*0*m0TEGChol |
| hsa-miR-924 MIMAT0004974 | 5'Pm0000f0005f05f05f05f00f00*0*5m0*5m0 *5m0*5m0*0 | m0m0m000m0m0m0m0m0m0m*m0*m0TEGChol |
| hsa-miR-92a MIMAT0000092 | 5'Pm005f005f0005f0f05f05f005f00*5m0*5m 0*5m0*5m0*5m0*0 | m0m00m00m0m0m0m0m00*m0*m0TEGChol |
| hsa-miR-92a-1* MIMAT0004507 | 5'Pm0000f05f005f05f05f05f05f05f05m0*5m0 *5m0*0*f0*0*0 | m0m0000m00m0m0m0m*m0*m0TEGChol |
| hsa-miR-92a-2* MIMAT0004508 | 5'Pm05f05f05f0f0000f0000f05m0*0*5m0*5 m0*5m0*5m0*0 | m0m0m0m0m0m0m0m0m0m000*0*m0TEGChol |
| hsa-miR-92b MIMAT0003218 | 5'Pm005f00f05f005f0f0005f0f00*5m0*0*5m 0*f0*5m0*0 | m0m00m0m00m00m0m0m00*m0*m0TEGChol |
| hsa-miR-92b* MIMAT0004792 | 5'Pm05f05f00f00005f005f05f0f00*0*0*5m0* 5m0*0*0 | m0m000m0m0m0m0m0m0m00*0*m0TEGChol |
| hsa-miR-93 MIMAT0000093 | 5'Pm00005f05f0005f005f00f00*5m0*0*0*f0 *5m0*0 | m0m0m00m0m0m0m00m0m0m0m*m0*m0TEGChol |
| hsa-miR-93* MIMAT0004509 | 5'Pm05f000f00005f0000f00*0*0*5m0*f0*0*0 | m0m0m0m0m0m0m0m0m0m0m0m0*0*m0TEGChol |
| hsa-miR-933 MIMAT0004976 | 5'Pm05f05f00f05f05f05f05f05f000f00*5m0*5 m0*5m0*5m0*0 | m0m0m0m00m0000m0m00*0*m0TEGChol |
| hsa-miR-934 MIMAT0004977 | 5'Pm005f05f05f05f05f0f0005f05f00*0*5m0 *0*5m0*5m0*0 | m0m00m0m0m000m0m000*m0*m0TEGChol |
| hsa-miR-935 MIMAT0004978 | 5'Pm0005f0f05f05f005f05f005f0f05m0*0*5m 0*5m0*f0*5m0*0 | m0m00m00m0m000m00m0*m0*m0TEGChol |
| hsa-miR-936 MIMAT0004979 | 5'Pm0000f05f005f05f05f05f00*5m0*0*5 m0*f0*0*0 | m0m000m0m0m0m0m0m0*m0*m0TEGChol |
| hsa-miR-937 MIMAT0004980 | 5'Pm05f05f05f05f05f005f05f000f05m0*0* 5m0*5m0*f0** | m0m0m0m00m00m00m000*0*m0TEGChol |
| hsa-miR-938 MIMAT0004981 | 5'Pm05f000f05f005f0f0000f05m0*5m0*0*0* f0*0*0 | m0m0m0m0m0m0m0m0m0m0*0*m0TEGChol |
| hsa-miR-939 MIMAT0004982 | 5'Pm005f005f05f05f0f005f05f05f05m0*0* 5m0*5m0*f0*0*0 | m0m0m0m0000m0m00*m0*m0TEGChol |
| hsa-miR-940 MIMAT0004983 | 5'Pm0005f0f005f005f05f05f0f05m0*5m0*0 *0*5m0*5m0*0 | m0m000m0m00m00m0m0*m0*m0TEGChol |
| hsa-miR-941 MIMAT0004984 | 5'Pm005f00f0005f0f0000f05m0*0*0*5m0*f0 *0*0 | m0m0m0m0m0m00m0m0m0m00*m0*m0TEGChol |
| hsa-miR-942 MIMAT0004985 | 5'Pm05f005f0f05f0005f05f05f005f05m0*0*5 m0*5m0*5m0*5m0*0 | m0m000m0m0m00m00m0*0*m0TEGChol |
| hsa-miR-943 MIMAT0004986 | 5'Pm0000f05f005f0f05f05f05f0f00*5m0*0*5 m0*f0*0*0 | m0m0000m00m0m0m0m*m0*m0TEGChol |
| hsa-miR-944 MIMAT0004987 | 5'Pm005f00f05f05f05f05f0000f00*0*0*5m 0*0*0 | m0m0m0m0m0000m0m00*m0*m0TEGChol |
| hsa-miR-95 MIMAT0000094 | 5'Pm00005f0000f05f000f05m0*5m0*5m0*0 *f0*5m0*0 | m0m0m0m00m0m0m0m0m0m0m0*m0*m0TEGChol |
| hsa-miR-96 MIMAT0000095 | 5'Pm0005f0f0005f0f05f0005f00*5m0*0*5 m0*5m0*0 | m0m0m0m00m00m0m0m0m00*m0*m0TEGChol |
| hsa-miR-96* MIMAT0004510 | 5'Pm005f00f005f005f00005f00*5m0*5m0*0 *f0*5m0*0 | m0m0m0m0m0m0m0m0m0m00*m0*m0TEGChol |
| hsa-miR-98 MIMAT0000096 | 5'Pm0000f005f05f05f05f000f00*0*0*5m0 *5m0*0 | m0m0m0m0m000m0m0m0m0*m0*m0TEGChol |
| hsa-miR-99a MIMAT0000097 | 5'Pm005f00f005f00f05f005f005f05m0*0*5m0 *5m0*f0*0*0 | m0m0m0m0m00m0m0m0m00*m0*m0TEGChol |
| hsa-miR-99a* MIMAT0004511 | 5'Pm005f05f05f05f000f05f005f05f05m0*5m0 *5m0*5m0*5m0*0 | m0m00m0m0m0m00m000*m0*m0TEGChol |
| hsa-miR-99b MIMAT0000689 | 5'Pm0000f0005f0f05f005f0f00*5m0*0*0*f0* 5m0*0 | m0m00m0m00m0m0m0m0m0*m0*m0TEGChol |
| hsa-miR-99b* MIMAT0004678 | 5'Pm00005f05f05f05f0f0000f05m0*0*5m0*5 m0*f0*0*0 | m0m0m0m0m0m0000m0m0m*m0*m0TEGChol |

Having thus described several aspects of at least one embodiment of this invention, it is to be appreciated various alterations, modifications, and improvements will readily occur to those skilled in the art. Such alterations, modifications, and improvements are intended to be part of this disclosure, and are intended to be within the spirit and scope of the invention. Accordingly, the foregoing description and drawings are by way of example only.

EQUIVALENTS

Those skilled in the art will recognize, or be able to ascertain using no more than routine experimentation, many equivalents to the specific embodiments of the invention described herein. Such equivalents are intended to be encompassed by the following claims.

All references, including patent documents, disclosed herein are incorporated by reference in their entirety. This application incorporates by reference the entire contents, including all the drawings and all parts of the specification.

SEQUENCE LISTING (4490 sequences)

SEQ ID NO: 1 - RNA, 19 nt, Artificial Sequence
  synthetic oligonucleotide
auugguauucagugugaug

SEQ ID NO: 2 - RNA, 19 nt, Artificial Sequence
  synthetic oligonucleotide
auucguauugagucugauc

SEQ ID NO: 3 - RNA, 19 nt, Artificial Sequence
  synthetic oligonucleotide
uagacuuccacagaacucu

SEQ ID NO: 4 - RNA, 19 nt, Artificial Sequence
  synthetic oligonucleotide
uagacuuccacagaacucu

SEQ ID NO: 5 - RNA, 19 nt, Artificial Sequence
  synthetic oligonucleotide
uagacuuccacagaacucu

SEQ ID NO: 6 - RNA, 19 nt, Artificial Sequence
  synthetic oligonucleotide
uagacuuccacagaacucu

SEQ ID NO: 7 - RNA, 19 nt, Artificial Sequence
  synthetic oligonucleotide
uagacuuccacagaacucu

SEQ ID NO: 8 - RNA, 19 nt, Artificial Sequence
  synthetic oligonucleotide
uagacuuccacagaacucu

SEQ ID NO: 9 - RNA, 17 nt, Artificial Sequence
  synthetic oligonucleotide
uagacuuccacagaacu

SEQ ID NO: 10 - RNA, 21 nt, Artificial Sequence
  synthetic oligonucleotide
auugguauucagugugaugac

SEQ ID NO: 11 - RNA, 21 nt, Artificial Sequence
  synthetic oligonucleotide
auucguauugagucugaucac

SEQ ID NO: 12 - RNA, 19 nt, Artificial Sequence
  synthetic oligonucleotide
uagacuuccacagaacucu

SEQ ID NO: 13 - RNA, 19 nt, Artificial Sequence
  synthetic oligonucleotide
uagacuuccacagaacucu

SEQ ID NO: 14 - RNA, 19 nt, Artificial Sequence
  synthetic oligonucleotide
uagacuuccacagaacucu

SEQ ID NO: 15 - RNA, 21 nt, Artificial Sequence
  synthetic oligonucleotide
uagacuuccacagaacucuuc

SEQ ID NO: 16 - RNA, 21 nt, Artificial Sequence
  synthetic oligonucleotide
uagacuuccacagaacucuuc

SEQ ID NO: 17 - RNA, 25 nt, Artificial Sequence
  synthetic oligonucleotide
uagacuuccacagaacucuucaaag

SEQ ID NO: 18 - RNA, 21 nt, Artificial Sequence
  synthetic oligonucleotide
auugguauucagugugaugac

SEQ ID NO: 19 - RNA, 21 nt, Artificial Sequence
  synthetic oligonucleotide
auucguauugagucugaucac

SEQ ID NO: 20 - RNA, 19 nt, Artificial Sequence
  synthetic oligonucleotide
uagacuuccacagaacucu

SEQ ID NO: 21 - RNA, 21 nt, Artificial Sequence
  synthetic oligonucleotide
auugguauucagugugaugac

SEQ ID NO: 22 - RNA, 21 nt, Artificial Sequence
  synthetic oligonucleotide
auucguauugagucugaucac

SEQ ID NO: 23 - RNA, 19 nt, Artificial Sequence
  synthetic oligonucleotide
uagacuuccacagaacucu

SEQ ID NO: 24 - RNA, 19 nt, Artificial Sequence
  synthetic oligonucleotide
uagacuuccacagaacucu

SEQ ID NO: 25 - RNA, 19 nt, Artificial Sequence
  synthetic oligonucleotide
uagacuuccacagaacucu

SEQ ID NO: 26 - RNA, 19 nt, Artificial Sequence
  synthetic oligonucleotide
uagacuuccacagaacucu

SEQ ID NO: 27 - RNA, 19 nt, Artificial Sequence
  synthetic oligonucleotide
uagacuuccacagaacucu

SEQ ID NO: 28 - RNA, 19 nt, Artificial Sequence
  synthetic oligonucleotide
uagacuuccacagaacucu

SEQ ID NO: 29 - RNA, 19 nt, Artificial Sequence
  synthetic oligonucleotide
uagacuuccacagaacucu

SEQ ID NO: 30 - RNA, 19 nt, Artificial Sequence
  synthetic oligonucleotide
uagacuuccacagaacucu

SEQ ID NO: 31 - RNA, 19 nt, Artificial Sequence
  synthetic oligonucleotide
uagacuuccacagaacucu

SEQ ID NO: 32 - RNA, 19 nt, Artificial Sequence
  synthetic oligonucleotide
uagacuuccacagaacucu

SEQ ID NO: 33 - RNA, 19 nt, Artificial Sequence
  synthetic oligonucleotide
uagacuuccacagaacucu

SEQ ID NO: 34 - RNA, 19 nt, Artificial Sequence
  synthetic oligonucleotide
uagacuuccacagaacucu

SEQ ID NO: 35 - RNA, 19 nt, Artificial Sequence
  synthetic oligonucleotide
uagacuuccacagaacucu

SEQ ID NO: 36 - RNA, 19 nt, Artificial Sequence
  synthetic oligonucleotide
uagacuuccacagaacucu

SEQ ID NO: 37 - RNA, 19 nt, Artificial Sequence
  synthetic oligonucleotide
uagacuuccacagaacucu

SEQ ID NO: 38 - RNA, 19 nt, Artificial Sequence
  synthetic oligonucleotide
uguuuuuguagccaaaucc

SEQ ID NO: 39 - RNA, 19 nt, Artificial Sequence
  synthetic oligonucleotide
uacuuucuucauuuccacc

SEQ ID NO: 40 - RNA, 19 nt, Artificial Sequence
  synthetic oligonucleotide
uucauuuccaccuuugccc

SEQ ID NO: 41 - RNA, 19 nt, Artificial Sequence
  synthetic oligonucleotide
cuuuguacuuucuucauuu

SEQ ID NO: 42 - RNA, 19 nt, Artificial Sequence
  synthetic oligonucleotide
ucuuuguacuuucuucauu

SEQ ID NO: 43 - RNA, 19 nt, Artificial Sequence
  synthetic oligonucleotide
ucagcagucacauugccca

SEQ ID NO: 44 - RNA, 19 nt, Artificial Sequence
  synthetic oligonucleotide
auugcccaagucuccaaca

SEQ ID NO: 45 - RNA, 19 nt, Artificial Sequence
  synthetic oligonucleotide
uucugcucgaaauugauga

SEQ ID NO: 46 - RNA, 19 nt, Artificial Sequence
  synthetic oligonucleotide
aaaucguauuugucaauca

SEQ ID NO: 47 - RNA, 19 nt, Artificial Sequence
  synthetic oligonucleotide
aaaucguauuugucaauca

SEQ ID NO: 48 - RNA, 19 nt, Artificial Sequence
  synthetic oligonucleotide
uagacuuccacagaacucu

SEQ ID NO: 49 - RNA, 19 nt, Artificial Sequence
  synthetic oligonucleotide
uagacuuccacagaacucu

SEQ ID NO: 50 - RNA, 19 nt, Artificial Sequence
  synthetic oligonucleotide
uagacauccuacacagcac

SEQ ID NO: 51 - RNA, 19 nt, Artificial Sequence
  synthetic oligonucleotide
uguuucuccagauccuugc

SEQ ID NO: 52 - RNA, 19 nt, Artificial Sequence
  synthetic oligonucleotide
uguuucuccagauccuugc

SEQ ID NO: 53 - RNA, 19 nt, Artificial Sequence
  synthetic oligonucleotide
uagcagaugaguccauuug

SEQ ID NO: 54 - RNA, 23 nt, Artificial Sequence
  synthetic oligonucleotide
uagcagaugaguccauuuggaga

SEQ ID NO: 55 - RNA, 19 nt, Artificial Sequence
  synthetic oligonucleotide
uagcagaugaguccauuug

SEQ ID NO: 56 - RNA, 23 nt, Artificial Sequence
  synthetic oligonucleotide
uagcagaugaguccauuuggaga

SEQ ID NO: 57 - RNA, 19 nt, Artificial Sequence
  synthetic oligonucleotide
auguuguuucuccagaucc

SEQ ID NO: 58 - RNA, 19 nt, Artificial Sequence
  synthetic oligonucleotide
auguuguuucuccagaucc

SEQ ID NO: 59 - RNA, 19 nt, Artificial Sequence
  synthetic oligonucleotide
uguuugagggacucuguga

SEQ ID NO: 60 - RNA, 19 nt, Artificial Sequence
  synthetic oligonucleotide
uguuugagggacucuguga

SEQ ID NO: 61 - RNA, 19 nt, Artificial Sequence
  synthetic oligonucleotide
auugguauucagugugaug

SEQ ID NO: 62 - RNA, 23 nt, Artificial Sequence
  synthetic oligonucleotide
auugguauucagugugaugacac

SEQ ID NO: 63 - RNA, 19 nt, Artificial Sequence
  synthetic oligonucleotide
auugguauucagugugaug

SEQ ID NO: 64 - RNA, 23 nt, Artificial Sequence
  synthetic oligonucleotide
auugguauucagugugaugacac

SEQ ID NO: 65 - RNA, 19 nt, Artificial Sequence
  synthetic oligonucleotide
uagacuuccacagaacucu

SEQ ID NO: 66 - RNA, 19 nt, Artificial Sequence
  synthetic oligonucleotide
uacaucuuccuguaguaca

SEQ ID NO: 67 - RNA, 19 nt, Artificial Sequence
  synthetic oligonucleotide
aggcgcuccacucuguggu

SEQ ID NO: 68 - RNA, 19 nt, Artificial Sequence
  synthetic oligonucleotide
ugucuuccagucgguaagc

SEQ ID NO: 69 - RNA, 19 nt, Artificial Sequence
  synthetic oligonucleotide
gaacaggcgcuccacucug

SEQ ID NO: 70 - RNA, 19 nt, Artificial Sequence
  synthetic oligonucleotide
caguuguaauggcaggcac

SEQ ID NO: 71 - RNA, 19 nt, Artificial Sequence
  synthetic oligonucleotide
agccagaaagcucaaacuu

SEQ ID NO: 72 - RNA, 19 nt, Artificial Sequence
  synthetic oligonucleotide
caggcgcuccacucugugg

SEQ ID NO: 73 - RNA, 19 nt, Artificial Sequence
  synthetic oligonucleotide
aacaggcgcuccacucugu

SEQ ID NO: 74 - RNA, 19 nt, Artificial Sequence
  synthetic oligonucleotide
agaaagcucaaacuugaua

SEQ ID NO: 75 - RNA, 19 nt, Artificial Sequence
  synthetic oligonucleotide
aguuguaauggcaggcaca

SEQ ID NO: 76 - RNA, 19 nt, Artificial Sequence
  synthetic oligonucleotide
cgugucuuccagucgguaa

SEQ ID NO: 77 - RNA, 19 nt, Artificial Sequence
  synthetic oligonucleotide
ggaccaggcaguuggcucu

SEQ ID NO: 78 - RNA, 19 nt, Artificial Sequence
  synthetic oligonucleotide
caggcacaggucuugauga

SEQ ID NO: 79 - RNA, 19 nt, Artificial Sequence
  synthetic oligonucleotide
gcgcuccacucuguggucu

SEQ ID NO: 80 - RNA, 19 nt, Artificial Sequence
  synthetic oligonucleotide
ggucuggaccaggcaguug

SEQ ID NO: 81 - RNA, 19 nt, Artificial Sequence
  synthetic oligonucleotide
acaguuguaauggcaggca

SEQ ID NO: 82 - RNA, 19 nt, Artificial Sequence
  synthetic oligonucleotide
guuguaauggcaggcacag

SEQ ID NO: 83 - RNA, 19 nt, Artificial Sequence
  synthetic oligonucleotide
ggacaguuguaauggcagg

SEQ ID NO: 84 - RNA, 19 nt, Artificial Sequence
  synthetic oligonucleotide
gacaguuguaauggcaggc

SEQ ID NO: 85 - RNA, 19 nt, Artificial Sequence
  synthetic oligonucleotide
ggcgcuccacucugugguc

SEQ ID NO: 86 - RNA, 19 nt, Artificial Sequence
  synthetic oligonucleotide
ucuuccagucgguaagccg

SEQ ID NO: 87 - RNA, 19 nt, Artificial Sequence
  synthetic oligonucleotide
ugucuccguacaucuuccu

SEQ ID NO: 88 - RNA, 19 nt, Artificial Sequence
  synthetic oligonucleotide
agcuucgcaaggccugacc

SEQ ID NO: 89 - RNA, 19 nt, Artificial Sequence
  synthetic oligonucleotide
cacuccucgcagcauuucc

SEQ ID NO: 90 - RNA, 19 nt, Artificial Sequence
  synthetic oligonucleotide
aaacuugauaggcuuggag

SEQ ID NO: 91 - RNA, 19 nt, Artificial Sequence
  synthetic oligonucleotide
acuccacagaauuuagcuc

SEQ ID NO: 92 - RNA, 19 nt, Artificial Sequence
  synthetic oligonucleotide
augucuccguacaucuucc

SEQ ID NO: 93 - RNA, 19 nt, Artificial Sequence
  synthetic oligonucleotide
aacuugauaggcuuggaga

SEQ ID NO: 94 - RNA, 19 nt, Artificial Sequence
  synthetic oligonucleotide
aagcucaaacuugauaggc

SEQ ID NO: 95 - RNA, 19 nt, Artificial Sequence
  synthetic oligonucleotide
acauacuccacagaauuua

SEQ ID NO: 96 - RNA, 19 nt, Artificial Sequence
  synthetic oligonucleotide
cuccacagaauuuagcucg

SEQ ID NO: 97 - RNA, 19 nt, Artificial Sequence
  synthetic oligonucleotide
ugugcuacugaaaucauuu

SEQ ID NO: 98 - RNA, 19 nt, Artificial Sequence
  synthetic oligonucleotide
aaagaugucauugucuccg

SEQ ID NO: 99 - RNA, 19 nt, Artificial Sequence
  synthetic oligonucleotide
gugcacugguacuugcagc

SEQ ID NO: 100 - RNA, 19 nt, Artificial Sequence
  synthetic oligonucleotide
aaacgugucuuccagucgg

SEQ ID NO: 101 - RNA, 19 nt, Artificial Sequence
  synthetic oligonucleotide
ucaaacuugauaggcuugg

SEQ ID NO: 102 - RNA, 19 nt, Artificial Sequence
  synthetic oligonucleotide
acagaauuuagcucgguau

SEQ ID NO: 103 - RNA, 19 nt, Artificial Sequence
  synthetic oligonucleotide
uuacauucuaccuauggug

SEQ ID NO: 104 - RNA, 19 nt, Artificial Sequence
  synthetic oligonucleotide
aaacugaucagcuauauag

SEQ ID NO: 105 - RNA, 19 nt, Artificial Sequence
  synthetic oligonucleotide
uaucugagcagaauuucca

SEQ ID NO: 106 - RNA, 19 nt, Artificial Sequence
  synthetic oligonucleotide
uuaacuuagauaacuguac

SEQ ID NO: 107 - RNA, 19 nt, Artificial Sequence
  synthetic oligonucleotide
uauuacucguauaagaugc

SEQ ID NO: 108 - RNA, 19 nt, Artificial Sequence
  synthetic oligonucleotide
aagcuguccagucuaaucg

SEQ ID NO: 109 - RNA, 19 nt, Artificial Sequence
  synthetic oligonucleotide
uaauaaaggccauuuguuc

SEQ ID NO: 110 - RNA, 19 nt, Artificial Sequence
  synthetic oligonucleotide
uuuagcucgguaugucuuc

SEQ ID NO: 111 - RNA, 19 nt, Artificial Sequence
  synthetic oligonucleotide
acacucucaacaaauaaac

SEQ ID NO: 112 - RNA, 19 nt, Artificial Sequence
  synthetic oligonucleotide
uagcucgguaugucuucau

SEQ ID NO: 113 - RNA, 19 nt, Artificial Sequence
  synthetic oligonucleotide
uaaccuuucugcugguacc

SEQ ID NO: 114 - RNA, 19 nt, Artificial Sequence
  synthetic oligonucleotide
uuaaggaacaacuugacuc

SEQ ID NO: 115 - RNA, 19 nt, Artificial Sequence
  synthetic oligonucleotide
uuacacuucaaauagcagg

SEQ ID NO: 116 - RNA, 19 nt, Artificial Sequence
  synthetic oligonucleotide
uccaggucagcuucgcaag

SEQ ID NO: 117 - RNA, 19 nt, Artificial Sequence
  synthetic oligonucleotide
cuucuucaugaccucgccg

SEQ ID NO: 118 - RNA, 19 nt, Artificial Sequence
  synthetic oligonucleotide
aaggccugaccaugcacag

SEQ ID NO: 119 - RNA, 19 nt, Artificial Sequence
  synthetic oligonucleotide
caaacgugucuuccagucg

SEQ ID NO: 120 - RNA, 19 nt, Artificial Sequence
  synthetic oligonucleotide
cuucgcaaggccugaccau

SEQ ID NO: 121 - RNA, 19 nt, Artificial Sequence
  synthetic oligonucleotide
cuuccagucgguaagccgc

SEQ ID NO: 122 - RNA, 19 nt, Artificial Sequence
  synthetic oligonucleotide
ccgaucuugcgguuggccg

SEQ ID NO: 123 - RNA, 19 nt, Artificial Sequence
  synthetic oligonucleotide
uucgcaaggccugaccaug

SEQ ID NO: 124 - RNA, 19 nt, Artificial Sequence
  synthetic oligonucleotide
agaauuuagcucgguaugu

SEQ ID NO: 125 - RNA, 19 nt, Artificial Sequence
  synthetic oligonucleotide
cauacuccacagaauuuag

SEQ ID NO: 126 - RNA, 19 nt, Artificial Sequence
  synthetic oligonucleotide
ugccaugucuccguacauc

SEQ ID NO: 127 - RNA, 19 nt, Artificial Sequence
  synthetic oligonucleotide
gaggcguugucauugguaa

SEQ ID NO: 128 - RNA, 19 nt, Artificial Sequence
  synthetic oligonucleotide
ucuucaugaccucgccguc

SEQ ID NO: 129 - RNA, 19 nt, Artificial Sequence
  synthetic oligonucleotide
uccacagaauuuagcucgg

SEQ ID NO: 130 - RNA, 19 nt, Artificial Sequence
  synthetic oligonucleotide
aacgugucuuccagucggu

SEQ ID NO: 131 - RNA, 19 nt, Artificial Sequence
  synthetic oligonucleotide
cuccguacaucuuccugua

SEQ ID NO: 132 - RNA, 19 nt, Artificial Sequence
  synthetic oligonucleotide
aggcguugucauugguaac

SEQ ID NO: 133 - RNA, 19 nt, Artificial Sequence
  synthetic oligonucleotide
ucaugaccucgccgucagg

SEQ ID NO: 134 - RNA, 19 nt, Artificial Sequence
  synthetic oligonucleotide
ggccaaacgugucuuccag

SEQ ID NO: 135 - RNA, 19 nt, Artificial Sequence
  synthetic oligonucleotide
gccaugucuccguacaucu

SEQ ID NO: 136 - RNA, 19 nt, Artificial Sequence
  synthetic oligonucleotide
ucgcaaggccugaccaugc

SEQ ID NO: 137 - RNA, 19 nt, Artificial Sequence
  synthetic oligonucleotide
aggucagcuucgcaaggcc

SEQ ID NO: 138 - RNA, 19 nt, Artificial Sequence
  synthetic oligonucleotide
ccguacaucuuccuguagu

SEQ ID NO: 139 - RNA, 19 nt, Artificial Sequence
  synthetic oligonucleotide
gagccgaagucacagaaga

SEQ ID NO: 140 - RNA, 19 nt, Artificial Sequence
  synthetic oligonucleotide
ggagccgaagucacagaag

SEQ ID NO: 141 - RNA, 19 nt, Artificial Sequence
  synthetic oligonucleotide
caaggccugaccaugcaca

SEQ ID NO: 142 - RNA, 19 nt, Artificial Sequence
  synthetic oligonucleotide
agcucaaacuugauaggcu

SEQ ID NO: 143 - RNA, 19 nt, Artificial Sequence
  synthetic oligonucleotide
cugcaguucuggccgacgg

SEQ ID NO: 144 - RNA, 19 nt, Artificial Sequence
  synthetic oligonucleotide
gguacauacuccacagaau

SEQ ID NO: 145 - RNA, 19 nt, Artificial Sequence
  synthetic oligonucleotide
cugcuucucuagccugcag

SEQ ID NO: 146 - RNA, 19 nt, Artificial Sequence
  synthetic oligonucleotide
gcaaggccugaccaugcac

SEQ ID NO: 147 - RNA, 19 nt, Artificial Sequence
  synthetic oligonucleotide
cagaauuuagcucgguaug

SEQ ID NO: 148 - RNA, 19 nt, Artificial Sequence
  synthetic oligonucleotide
ccaaacgugucuuccaguc

SEQ ID NO: 149 - RNA, 19 nt, Artificial Sequence
  synthetic oligonucleotide
cuucaugaccucgccguca

SEQ ID NO: 150 - RNA, 19 nt, Artificial Sequence
  synthetic oligonucleotide
gcuucgcaaggccugacca

SEQ ID NO: 151 - RNA, 19 nt, Artificial Sequence
  synthetic oligonucleotide
ucagcuucgcaaggccuga

SEQ ID NO: 152 - RNA, 19 nt, Artificial Sequence
  synthetic oligonucleotide
gucuuccagucgguaagcc

SEQ ID NO: 153 - RNA, 19 nt, Artificial Sequence
  synthetic oligonucleotide
caaacuugauaggcuugga

SEQ ID NO: 154 - RNA, 19 nt, Artificial Sequence
  synthetic oligonucleotide
aggucuuggaacaggcgcu

SEQ ID NO: 155 - RNA, 19 nt, Artificial Sequence
  synthetic oligonucleotide
caggucagcuucgcaaggc

SEQ ID NO: 156 - RNA, 19 nt, Artificial Sequence
  synthetic oligonucleotide
gucagcuucgcaaggccug

SEQ ID NO: 157 - RNA, 19 nt, Artificial Sequence
  synthetic oligonucleotide
ggcguugucauugguaacc

SEQ ID NO: 158 - RNA, 19 nt, Artificial Sequence
  synthetic oligonucleotide
cgugcacugguacuugcag

SEQ ID NO: 159 - RNA, 19 nt, Artificial Sequence
  synthetic oligonucleotide
gucuuggaacaggcgcucc

SEQ ID NO: 160 - RNA, 19 nt, Artificial Sequence
  synthetic oligonucleotide
ccaugucuccguacaucuu

SEQ ID NO: 161 - RNA, 19 nt, Artificial Sequence
  synthetic oligonucleotide
ggucagcuucgcaaggccu

SEQ ID NO: 162 - RNA, 19 nt, Artificial Sequence
  synthetic oligonucleotide
cagcuucgcaaggccugac

SEQ ID NO: 163 - RNA, 19 nt, Artificial Sequence
  synthetic oligonucleotide
gccgaagucacagaagagg

SEQ ID NO: 164 - RNA, 19 nt, Artificial Sequence
  synthetic oligonucleotide
cacagaauuuagcucggua

SEQ ID NO: 165 - RNA, 19 nt, Artificial Sequence
  synthetic oligonucleotide
ccacagaauuuagcucggu

SEQ ID NO: 166 - RNA, 19 nt, Artificial Sequence
  synthetic oligonucleotide
gccaaacgugucuuccagu

SEQ ID NO: 167 - RNA, 19 nt, Artificial Sequence
  synthetic oligonucleotide
gccgaucuugcgguuggcc

SEQ ID NO: 168 - RNA, 19 nt, Artificial Sequence
  synthetic oligonucleotide
cucaaacuugauaggcuug

SEQ ID NO: 169 - RNA, 19 nt, Artificial Sequence
  synthetic oligonucleotide
ccaggucagcuucgcaagg

SEQ ID NO: 170 - RNA, 19 nt, Artificial Sequence
  synthetic oligonucleotide
uuugacuaaaugcaaagug

SEQ ID NO: 171 - RNA, 19 nt, Artificial Sequence
  synthetic oligonucleotide
uguuuuuguagccaaaucc

SEQ ID NO: 172 - RNA, 19 nt, Artificial Sequence
  synthetic oligonucleotide
uguuuuuguagccaaaucc

SEQ ID NO: 173 - RNA, 19 nt, Artificial Sequence
  synthetic oligonucleotide
uguuuuuguagccaaaucc

SEQ ID NO: 174 - RNA, 19 nt, Artificial Sequence
  synthetic oligonucleotide
aaaucguauuugucaauca

SEQ ID NO: 175 - RNA, 19 nt, Artificial Sequence
  synthetic oligonucleotide
aaaucguauuugucaauca

SEQ ID NO: 176 - RNA, 21 nt, Artificial Sequence
  synthetic oligonucleotide
gucaucacacugaauaccaau

SEQ ID NO: 177 - RNA, 21 nt, Artificial Sequence
  synthetic oligonucleotide
gugaucagacucaauacgaau

SEQ ID NO: 178 - RNA, 13 nt, Artificial Sequence
  synthetic oligonucleotide
cuguggaagucua

SEQ ID NO: 179 - RNA, 13 nt, Artificial Sequence
  synthetic oligonucleotide
cuguggaagucua

SEQ ID NO: 180 - RNA, 13 nt, Artificial Sequence
  synthetic oligonucleotide
cuguggaagucua

SEQ ID NO: 181 - RNA, 13 nt, Artificial Sequence
  synthetic oligonucleotide
cuguggaagucua

SEQ ID NO: 182 - RNA, 13 nt, Artificial Sequence
  synthetic oligonucleotide
cuguggaagucua

SEQ ID NO: 183 - RNA, 13 nt, Artificial Sequence
  synthetic oligonucleotide
cuguggaagucua

SEQ ID NO: 184 - RNA, 13 nt, Artificial Sequence
  synthetic oligonucleotide
cuguggaagucua

SEQ ID NO: 185 - RNA, 13 nt, Artificial Sequence
  synthetic oligonucleotide
cuguggaagucua

SEQ ID NO: 186 - RNA, 13 nt, Artificial Sequence
  synthetic oligonucleotide
cuguggaagucua

SEQ ID NO: 187 - RNA, 13 nt, Artificial Sequence
  synthetic oligonucleotide
cuguggaagucua

SEQ ID NO: 188 - RNA, 21 nt, Artificial Sequence
  synthetic oligonucleotide
gucaucacacugaauaccaau

SEQ ID NO: 189 - RNA, 21 nt, Artificial Sequence
  synthetic oligonucleotide
gugaucagacucaauacgaau

SEQ ID NO: 190 - RNA, 13 nt, Artificial Sequence
  synthetic oligonucleotide
cuguggaagucua

SEQ ID NO: 191 - RNA, 13 nt, Artificial Sequence
  synthetic oligonucleotide
cuguggaagucua

SEQ ID NO: 192 - RNA, 13 nt, Artificial Sequence
  synthetic oligonucleotide
cuguggaagucua

SEQ ID NO: 193 - RNA, 13 nt, Artificial Sequence
  synthetic oligonucleotide
cuguggaagucua

SEQ ID NO: 194 - RNA, 13 nt, Artificial Sequence
  synthetic oligonucleotide
cuguggaagucua

SEQ ID NO: 195 - RNA, 13 nt, Artificial Sequence
  synthetic oligonucleotide
cuguggaagucua

SEQ ID NO: 196 - RNA, 27 nt, Artificial Sequence
  synthetic oligonucleotide
ucauagguaaccucugguugaaaguga

SEQ ID NO: 197 - RNA, 27 nt, Artificial Sequence
  synthetic oligonucleotide
cggcuacaggugcuuaugaagaaagua

SEQ ID NO: 198 - RNA, 21 nt, Artificial Sequence
  synthetic oligonucleotide
gucaucacacugaauaccaau

SEQ ID NO: 199 - RNA, 21 nt, Artificial Sequence
  synthetic oligonucleotide
gugaucagacucaauacgaau

SEQ ID NO: 200 - RNA, 13 nt, Artificial Sequence
  synthetic oligonucleotide
cuguggaagucua

SEQ ID NO: 201 - RNA, 21 nt, Artificial Sequence
  synthetic oligonucleotide
gucaucacacugaauaccaau

SEQ ID NO: 202 - RNA, 21 nt, Artificial Sequence
  synthetic oligonucleotide
gugaucagacucaauacgaau

SEQ ID NO: 203 - RNA, 13 nt, Artificial Sequence
  synthetic oligonucleotide
uguaggaugucua

SEQ ID NO: 204 - RNA, 13 nt, Artificial Sequence
  synthetic oligonucleotide
cuguggaagucua

SEQ ID NO: 205 - RNA, 13 nt, Artificial Sequence
  synthetic oligonucleotide
cuguggaagucua

SEQ ID NO: 206 - RNA, 13 nt, Artificial Sequence
  synthetic oligonucleotide
acugaauaccaau

SEQ ID NO: 207 - RNA, 13 nt, Artificial Sequence
  synthetic oligonucleotide
cuguggaagucua

SEQ ID NO: 208 - RNA, 13 nt, Artificial Sequence
  synthetic oligonucleotide
cuguggaagucua

SEQ ID NO: 209 - RNA, 13 nt, Artificial Sequence
  synthetic oligonucleotide
cuguggaagucua

SEQ ID NO: 210 - RNA, 13 nt, Artificial Sequence
  synthetic oligonucleotide
cuguggaagucua

SEQ ID NO: 211 - RNA, 13 nt, Artificial Sequence
  synthetic oligonucleotide
cuguggaagucua

SEQ ID NO: 212 - RNA, 13 nt, Artificial Sequence
  synthetic oligonucleotide
cuguggaagucua

SEQ ID NO: 213 - RNA, 13 nt, Artificial Sequence
  synthetic oligonucleotide
cuguggaagucua

SEQ ID NO: 214 - RNA, 13 nt, Artificial Sequence
  synthetic oligonucleotide
cuguggaagucua

SEQ ID NO: 215 - RNA, 13 nt, Artificial Sequence
  synthetic oligonucleotide
cuguggaagucua

SEQ ID NO: 216 - RNA, 13 nt, Artificial Sequence
  synthetic oligonucleotide
cuguggaagucua

SEQ ID NO: 217 - RNA, 13 nt, Artificial Sequence
  synthetic oligonucleotide
cuguggaagucua

SEQ ID NO: 218 - RNA, 13 nt, Artificial Sequence
  synthetic oligonucleotide
cuguggaagucua

SEQ ID NO: 219 - RNA, 13 nt, Artificial Sequence
  synthetic oligonucleotide
cuguggaagucua

SEQ ID NO: 220 - RNA, 19 nt, Artificial Sequence
  synthetic oligonucleotide
agaguucuguggaagucua

SEQ ID NO: 221 - RNA, 19 nt, Artificial Sequence
  synthetic oligonucleotide
agaguucuguggaagucua

SEQ ID NO: 222 - RNA, 13 nt, Artificial Sequence
  synthetic oligonucleotide
auuuggcuacaaa

SEQ ID NO: 223 - RNA, 13 nt, Artificial Sequence
  synthetic oligonucleotide
acaaauacgauuu

SEQ ID NO: 224 - RNA, 13 nt, Artificial Sequence
  synthetic oligonucleotide
acaaauacgauuu

SEQ ID NO: 225 - RNA, 13 nt, Artificial Sequence
  synthetic oligonucleotide
cuguggaagucua

SEQ ID NO: 226 - RNA, 13 nt, Artificial Sequence
  synthetic oligonucleotide
aaugaagaaagua

SEQ ID NO: 227 - RNA, 13 nt, Artificial Sequence
  synthetic oligonucleotide
agguggaaaugaa

SEQ ID NO: 228 - RNA, 13 nt, Artificial Sequence
  synthetic oligonucleotide
agaaaguacaaag

SEQ ID NO: 229 - RNA, 13 nt, Artificial Sequence
  synthetic oligonucleotide
gaaaguacaaaga

SEQ ID NO: 230 - RNA, 13 nt, Artificial Sequence
  synthetic oligonucleotide
augugacugcuga

SEQ ID NO: 231 - RNA, 13 nt, Artificial Sequence
  synthetic oligonucleotide
agacuugggcaau

SEQ ID NO: 232 - RNA, 13 nt, Artificial Sequence
  synthetic oligonucleotide
auuucgagcagaa

SEQ ID NO: 233 - RNA, 13 nt, Artificial Sequence
  synthetic oligonucleotide
aucuggagaaaca

SEQ ID NO: 234 - RNA, 13 nt, Artificial Sequence
  synthetic oligonucleotide
ucagaacaagaaa

SEQ ID NO: 235 - RNA, 13 nt, Artificial Sequence
  synthetic oligonucleotide
gacucaucugcua

SEQ ID NO: 236 - RNA, 13 nt, Artificial Sequence
  synthetic oligonucleotide
ggagaaacaacau

SEQ ID NO: 237 - RNA, 13 nt, Artificial Sequence
  synthetic oligonucleotide
agucccucaaaca

SEQ ID NO: 238 - RNA, 13 nt, Artificial Sequence
  synthetic oligonucleotide
ggcuacaaaaaca

SEQ ID NO: 239 - RNA, 15 nt, Artificial Sequence
  synthetic oligonucleotide
agaucuggagaaaca

SEQ ID NO: 240 - RNA, 15 nt, Artificial Sequence
  synthetic oligonucleotide
uggacucaucugcua

SEQ ID NO: 241 - RNA, 15 nt, Artificial Sequence
  synthetic oligonucleotide
cuggagaaacaacau

SEQ ID NO: 242 - RNA, 15 nt, Artificial Sequence
  synthetic oligonucleotide
agagucccucaaaca

SEQ ID NO: 243 - RNA, 13 nt, Artificial Sequence
  synthetic oligonucleotide
acugaauaccaau

SEQ ID NO: 244 - RNA, 15 nt, Artificial Sequence
  synthetic oligonucleotide
acacugaauaccaau

SEQ ID NO: 245 - RNA, 13 nt, Artificial Sequence
  synthetic oligonucleotide
aaugaagaaagua

SEQ ID NO: 246 - RNA, 13 nt, Artificial Sequence
  synthetic oligonucleotide
agguggaaaugaa

SEQ ID NO: 247 - RNA, 13 nt, Artificial Sequence
  synthetic oligonucleotide
agaaaguacaaag

SEQ ID NO: 248 - RNA, 13 nt, Artificial Sequence
  synthetic oligonucleotide
gaaaguacaaaga

SEQ ID NO: 249 - RNA, 13 nt, Artificial Sequence
  synthetic oligonucleotide
augugacugcuga

SEQ ID NO: 250 - RNA, 13 nt, Artificial Sequence
  synthetic oligonucleotide
agacuugggcaau

SEQ ID NO: 251 - RNA, 13 nt, Artificial Sequence
  synthetic oligonucleotide
auuucgagcagaa

SEQ ID NO: 252 - RNA, 13 nt, Artificial Sequence
  synthetic oligonucleotide
acaaauacgauuu

SEQ ID NO: 253 - RNA, 13 nt, Artificial Sequence
  synthetic oligonucleotide
acaaauacgauuu

SEQ ID NO: 254 - RNA, 19 nt, Artificial Sequence
  synthetic oligonucleotide
agaguucuguggaagucua

SEQ ID NO: 255 - RNA, 13 nt, Artificial Sequence
  synthetic oligonucleotide
acaggaagaugua

SEQ ID NO: 256 - RNA, 13 nt, Artificial Sequence
  synthetic oligonucleotide
gaguggagcgccu

SEQ ID NO: 257 - RNA, 13 nt, Artificial Sequence
  synthetic oligonucleotide
cgacuggaagaca

SEQ ID NO: 258 - RNA, 13 nt, Artificial Sequence
  synthetic oligonucleotide
ggagcgccuguuc

SEQ ID NO: 259 - RNA, 13 nt, Artificial Sequence
  synthetic oligonucleotide
gccauuacaacug

SEQ ID NO: 260 - RNA, 13 nt, Artificial Sequence
  synthetic oligonucleotide
gagcuuucuggcu

SEQ ID NO: 261 - RNA, 13 nt, Artificial Sequence
  synthetic oligonucleotide
aguggagcgccug

SEQ ID NO: 262 - RNA, 13 nt, Artificial Sequence
  synthetic oligonucleotide
uggagcgccuguu

SEQ ID NO: 263 - RNA, 13 nt, Artificial Sequence
  synthetic oligonucleotide
guuugagcuuucu

SEQ ID NO: 264 - RNA, 13 nt, Artificial Sequence
  synthetic oligonucleotide
ugccauuacaacu

SEQ ID NO: 265 - RNA, 13 nt, Artificial Sequence
  synthetic oligonucleotide
acuggaagacacg

SEQ ID NO: 266 - RNA, 13 nt, Artificial Sequence
  synthetic oligonucleotide
aacugccuggucc

SEQ ID NO: 267 - RNA, 13 nt, Artificial Sequence
  synthetic oligonucleotide
agaccugugccug

SEQ ID NO: 268 - RNA, 13 nt, Artificial Sequence
  synthetic oligonucleotide
cagaguggagcgc

SEQ ID NO: 269 - RNA, 13 nt, Artificial Sequence
  synthetic oligonucleotide
ccugguccagacc

SEQ ID NO: 270 - RNA, 13 nt, Artificial Sequence
  synthetic oligonucleotide
ccauuacaacugu

SEQ ID NO: 271 - RNA, 13 nt, Artificial Sequence
  synthetic oligonucleotide
cugccauuacaac

SEQ ID NO: 272 - RNA, 13 nt, Artificial Sequence
  synthetic oligonucleotide
auuacaacugucc

SEQ ID NO: 273 - RNA, 13 nt, Artificial Sequence
  synthetic oligonucleotide
cauuacaacuguc

SEQ ID NO: 274 - RNA, 13 nt, Artificial Sequence
  synthetic oligonucleotide
agaguggagcgcc

SEQ ID NO: 275 - RNA, 13 nt, Artificial Sequence
  synthetic oligonucleotide
accgacuggaaga

SEQ ID NO: 276 - RNA, 13 nt, Artificial Sequence
  synthetic oligonucleotide
auguacggagaca

SEQ ID NO: 277 - RNA, 13 nt, Artificial Sequence
  synthetic oligonucleotide
gccuugcgaagcu

SEQ ID NO: 278 - RNA, 13 nt, Artificial Sequence
  synthetic oligonucleotide
gcugcgaggagug

SEQ ID NO: 279 - RNA, 13 nt, Artificial Sequence
  synthetic oligonucleotide
gccuaucaaguuu

SEQ ID NO: 280 - RNA, 13 nt, Artificial Sequence
  synthetic oligonucleotide
aauucuguggagu

SEQ ID NO: 281 - RNA, 13 nt, Artificial Sequence
  synthetic oligonucleotide
uguacggagacau

SEQ ID NO: 282 - RNA, 13 nt, Artificial Sequence
  synthetic oligonucleotide
agccuaucaaguu

SEQ ID NO: 283 - RNA, 13 nt, Artificial Sequence
  synthetic oligonucleotide
caaguuugagcuu

SEQ ID NO: 284 - RNA, 13 nt, Artificial Sequence
  synthetic oligonucleotide
cuguggaguaugu

SEQ ID NO: 285 - RNA, 13 nt, Artificial Sequence
  synthetic oligonucleotide
aaauucuguggag

SEQ ID NO: 286 - RNA, 13 nt, Artificial Sequence
  synthetic oligonucleotide
uuucaguagcaca

SEQ ID NO: 287 - RNA, 13 nt, Artificial Sequence
  synthetic oligonucleotide
caaugacaucuuu

SEQ ID NO: 288 - RNA, 13 nt, Artificial Sequence
  synthetic oligonucleotide
aguaccagugcac

SEQ ID NO: 289 - RNA, 13 nt, Artificial Sequence
  synthetic oligonucleotide
ggaagacacguuu

SEQ ID NO: 290 - RNA, 13 nt, Artificial Sequence
  synthetic oligonucleotide
cuaucaaguuuga

SEQ ID NO: 291 - RNA, 13 nt, Artificial Sequence
  synthetic oligonucleotide
agcuaaauucugu

SEQ ID NO: 292 - RNA, 13 nt, Artificial Sequence
  synthetic oligonucleotide
agguagaauguaa

SEQ ID NO: 293 - RNA, 13 nt, Artificial Sequence
  synthetic oligonucleotide
agcugaucaguuu

SEQ ID NO: 294 - RNA, 13 nt, Artificial Sequence
  synthetic oligonucleotide
uucugcucagaua

SEQ ID NO: 295 - RNA, 13 nt, Artificial Sequence
  synthetic oligonucleotide
uuaucuaaguuaa

SEQ ID NO: 296 - RNA, 13 nt, Artificial Sequence
  synthetic oligonucleotide
uauacgaguaaua

SEQ ID NO: 297 - RNA, 13 nt, Artificial Sequence
  synthetic oligonucleotide
gacuggacagcuu

SEQ ID NO: 298 - RNA, 13 nt, Artificial Sequence
  synthetic oligonucleotide
auggccuuuauua

SEQ ID NO: 299 - RNA, 13 nt, Artificial Sequence
  synthetic oligonucleotide
auaccgagcuaaa

SEQ ID NO: 300 - RNA, 13 nt, Artificial Sequence
  synthetic oligonucleotide
uuguugagagugu

SEQ ID NO: 301 - RNA, 13 nt, Artificial Sequence
  synthetic oligonucleotide
acauaccgagcua

SEQ ID NO: 302 - RNA, 13 nt, Artificial Sequence
  synthetic oligonucleotide
agcagaaagguua

SEQ ID NO: 303 - RNA, 13 nt, Artificial Sequence
  synthetic oligonucleotide
aguuguuccuuaa

SEQ ID NO: 304 - RNA, 13 nt, Artificial Sequence
  synthetic oligonucleotide
auuugaaguguaa

SEQ ID NO: 305 - RNA, 13 nt, Artificial Sequence
  synthetic oligonucleotide
aagcugaccugga

SEQ ID NO: 306 - RNA, 13 nt, Artificial Sequence
  synthetic oligonucleotide
ggucaugaagaag

SEQ ID NO: 307 - RNA, 13 nt, Artificial Sequence
  synthetic oligonucleotide
auggucaggccuu

SEQ ID NO: 308 - RNA, 13 nt, Artificial Sequence
  synthetic oligonucleotide
gaagacacguuug

SEQ ID NO: 309 - RNA, 13 nt, Artificial Sequence
  synthetic oligonucleotide
aggccuugcgaag

SEQ ID NO: 310 - RNA, 13 nt, Artificial Sequence
  synthetic oligonucleotide
uaccgacuggaag

SEQ ID NO: 311 - RNA, 13 nt, Artificial Sequence
  synthetic oligonucleotide
accgcaagaucgg

SEQ ID NO: 312 - RNA, 13 nt, Artificial Sequence
  synthetic oligonucleotide
caggccuugcgaa

SEQ ID NO: 313 - RNA, 13 nt, Artificial Sequence
  synthetic oligonucleotide
cgagcuaaauucu

SEQ ID NO: 314 - RNA, 13 nt, Artificial Sequence
  synthetic oligonucleotide
ucuguggaguaug

SEQ ID NO: 315 - RNA, 13 nt, Artificial Sequence
  synthetic oligonucleotide
cggagacauggca

SEQ ID NO: 316 - RNA, 13 nt, Artificial Sequence
  synthetic oligonucleotide
augacaacgccuc

SEQ ID NO: 317 - RNA, 13 nt, Artificial Sequence
  synthetic oligonucleotide
gaggucaugaaga

SEQ ID NO: 318 - RNA, 13 nt, Artificial Sequence
  synthetic oligonucleotide
uaaauucugugga

SEQ ID NO: 319 - RNA, 13 nt, Artificial Sequence
  synthetic oligonucleotide
uggaagacacguu

SEQ ID NO: 320 - RNA, 13 nt, Artificial Sequence
  synthetic oligonucleotide
aagauguacggag

SEQ ID NO: 321 - RNA, 13 nt, Artificial Sequence
  synthetic oligonucleotide
aaugacaacgccu

SEQ ID NO: 322 - RNA, 13 nt, Artificial Sequence
  synthetic oligonucleotide
ggcgaggucauga

SEQ ID NO: 323 - RNA, 13 nt, Artificial Sequence
  synthetic oligonucleotide
gacacguuuggcc

SEQ ID NO: 324 - RNA, 13 nt, Artificial Sequence
  synthetic oligonucleotide
acggagacauggc

SEQ ID NO: 325 - RNA, 13 nt, Artificial Sequence
  synthetic oligonucleotide
ucaggccuugcga

SEQ ID NO: 326 - RNA, 13 nt, Artificial Sequence
  synthetic oligonucleotide
gcgaagcugaccu

SEQ ID NO: 327 - RNA, 13 nt, Artificial Sequence
  synthetic oligonucleotide
ggaagauguacgg

SEQ ID NO: 328 - RNA, 13 nt, Artificial Sequence
  synthetic oligonucleotide
gugacuucggcuc

SEQ ID NO: 329 - RNA, 13 nt, Artificial Sequence
  synthetic oligonucleotide
ugacuucggcucc

SEQ ID NO: 330 - RNA, 13 nt, Artificial Sequence
  synthetic oligonucleotide
uggucaggccuug

SEQ ID NO: 331 - RNA, 13 nt, Artificial Sequence
  synthetic oligonucleotide
ucaaguuugagcu

SEQ ID NO: 332 - RNA, 13 nt, Artificial Sequence
  synthetic oligonucleotide
gccagaacugcag

SEQ ID NO: 333 - RNA, 13 nt, Artificial Sequence
  synthetic oligonucleotide
uggaguauguacc

SEQ ID NO: 334 - RNA, 13 nt, Artificial Sequence
  synthetic oligonucleotide
gcuagagaagcag

SEQ ID NO: 335 - RNA, 13 nt, Artificial Sequence
  synthetic oligonucleotide
ggucaggccuugc

SEQ ID NO: 336 - RNA, 13 nt, Artificial Sequence
  synthetic oligonucleotide
gagcuaaauucug

SEQ ID NO: 337 - RNA, 13 nt, Artificial Sequence
  synthetic oligonucleotide
aagacacguuugg

SEQ ID NO: 338 - RNA, 13 nt, Artificial Sequence
  synthetic oligonucleotide
cgaggucaugaag

SEQ ID NO: 339 - RNA, 13 nt, Artificial Sequence
  synthetic oligonucleotide
ggccuugcgaagc

SEQ ID NO: 340 - RNA, 13 nt, Artificial Sequence
  synthetic oligonucleotide
cuugcgaagcuga

SEQ ID NO: 341 - RNA, 13 nt, Artificial Sequence
  synthetic oligonucleotide
ccgacuggaagac

SEQ ID NO: 342 - RNA, 13 nt, Artificial Sequence
  synthetic oligonucleotide
ccuaucaaguuug

SEQ ID NO: 343 - RNA, 13 nt, Artificial Sequence
  synthetic oligonucleotide
uguuccaagaccu

SEQ ID NO: 344 - RNA, 13 nt, Artificial Sequence
  synthetic oligonucleotide
cgaagcugaccug

SEQ ID NO: 345 - RNA, 13 nt, Artificial Sequence
  synthetic oligonucleotide
uugcgaagcugac

SEQ ID NO: 346 - RNA, 13 nt, Artificial Sequence
  synthetic oligonucleotide
caaugacaacgcc

SEQ ID NO: 347 - RNA, 13 nt, Artificial Sequence
  synthetic oligonucleotide
guaccagugcacg

SEQ ID NO: 348 - RNA, 13 nt, Artificial Sequence
  synthetic oligonucleotide
ccuguuccaagac

SEQ ID NO: 349 - RNA, 13 nt, Artificial Sequence
  synthetic oligonucleotide
uacggagacaugg

SEQ ID NO: 350 - RNA, 13 nt, Artificial Sequence
  synthetic oligonucleotide
ugcgaagcugacc

SEQ ID NO: 351 - RNA, 13 nt, Artificial Sequence
  synthetic oligonucleotide
ccuugcgaagcug

SEQ ID NO: 352 - RNA, 13 nt, Artificial Sequence
  synthetic oligonucleotide
cugugacuucggc

SEQ ID NO: 353 - RNA, 13 nt, Artificial Sequence
  synthetic oligonucleotide
gcuaaauucugug

SEQ ID NO: 354 - RNA, 13 nt, Artificial Sequence
  synthetic oligonucleotide
cuaaauucugugg

SEQ ID NO: 355 - RNA, 13 nt, Artificial Sequence
  synthetic oligonucleotide
agacacguuuggc

SEQ ID NO: 356 - RNA, 13 nt, Artificial Sequence
  synthetic oligonucleotide
ccgcaagaucggc

SEQ ID NO: 357 - RNA, 13 nt, Artificial Sequence
  synthetic oligonucleotide
uaucaaguuugag

SEQ ID NO: 358 - RNA, 13 nt, Artificial Sequence
  synthetic oligonucleotide
gaagcugaccugg

SEQ ID NO: 359 - RNA, 13 nt, Artificial Sequence
  synthetic oligonucleotide
cucaugaauuaga

SEQ ID NO: 360 - RNA, 13 nt, Artificial Sequence
  synthetic oligonucleotide
cugaggucaauua

SEQ ID NO: 361 - RNA, 13 nt, Artificial Sequence
  synthetic oligonucleotide
gaggucaauuaaa

SEQ ID NO: 362 - RNA, 13 nt, Artificial Sequence
  synthetic oligonucleotide
ucugaggucaauu

SEQ ID NO: 363 - RNA, 13 nt, Artificial Sequence
  synthetic oligonucleotide
ugaggucaauuaa

SEQ ID NO: 364 - RNA, 13 nt, Artificial Sequence
  synthetic oligonucleotide
uucugaggucaau

SEQ ID NO: 365 - RNA, 13 nt, Artificial Sequence
  synthetic oligonucleotide
gucagcuggauga

SEQ ID NO: 366 - RNA, 13 nt, Artificial Sequence
  synthetic oligonucleotide
uucugaugaaucu

SEQ ID NO: 367 - RNA, 13 nt, Artificial Sequence
  synthetic oligonucleotide
uggacugagguca

SEQ ID NO: 368 - RNA, 13 nt, Artificial Sequence
  synthetic oligonucleotide
gagucucaccauu

SEQ ID NO: 369 - RNA, 13 nt, Artificial Sequence
  synthetic oligonucleotide
gacugaggucaaa

SEQ ID NO: 370 - RNA, 13 nt, Artificial Sequence
  synthetic oligonucleotide
ucacagccaugaa

SEQ ID NO: 371 - RNA, 13 nt, Artificial Sequence
  synthetic oligonucleotide
agucucaccauuc

SEQ ID NO: 372 - RNA, 13 nt, Artificial Sequence
  synthetic oligonucleotide
aagcggaaagcca

SEQ ID NO: 373 - RNA, 13 nt, Artificial Sequence
  synthetic oligonucleotide
agcggaaagccaa

SEQ ID NO: 374 - RNA, 13 nt, Artificial Sequence
  synthetic oligonucleotide
accacauggauga

SEQ ID NO: 375 - RNA, 13 nt, Artificial Sequence
  synthetic oligonucleotide
gccaugaccacau

SEQ ID NO: 376 - RNA, 13 nt, Artificial Sequence
  synthetic oligonucleotide
aagccaugaccac

SEQ ID NO: 377 - RNA, 13 nt, Artificial Sequence
  synthetic oligonucleotide
gcggaaagccaau

SEQ ID NO: 378 - RNA, 13 nt, Artificial Sequence
  synthetic oligonucleotide
aaauuucguauuu

SEQ ID NO: 379 - RNA, 13 nt, Artificial Sequence
  synthetic oligonucleotide
auuucguauuucu

SEQ ID NO: 380 - RNA, 13 nt, Artificial Sequence
  synthetic oligonucleotide
aaagccaugacca

SEQ ID NO: 381 - RNA, 13 nt, Artificial Sequence
  synthetic oligonucleotide
acauggaugauau

SEQ ID NO: 382 - RNA, 13 nt, Artificial Sequence
  synthetic oligonucleotide
gaaauuucguauu

SEQ ID NO: 383 - RNA, 13 nt, Artificial Sequence
  synthetic oligonucleotide
gcgccuucugauu

SEQ ID NO: 384 - RNA, 13 nt, Artificial Sequence
  synthetic oligonucleotide
auuucucaugaau

SEQ ID NO: 385 - RNA, 13 nt, Artificial Sequence
  synthetic oligonucleotide
cucucaugaauag

SEQ ID NO: 386 - RNA, 13 nt, Artificial Sequence
  synthetic oligonucleotide
aaguccaacgaaa

SEQ ID NO: 387 - RNA, 13 nt, Artificial Sequence
  synthetic oligonucleotide
augaugagagcaa

SEQ ID NO: 388 - RNA, 13 nt, Artificial Sequence
  synthetic oligonucleotide
gcgaggaguugaa

SEQ ID NO: 389 - RNA, 13 nt, Artificial Sequence
  synthetic oligonucleotide
ugauugauaguca

SEQ ID NO: 390 - RNA, 13 nt, Artificial Sequence
  synthetic oligonucleotide
agauagugcaucu

SEQ ID NO: 391 - RNA, 13 nt, Artificial Sequence
  synthetic oligonucleotide
auguguaucuauu

SEQ ID NO: 392 - RNA, 13 nt, Artificial Sequence
  synthetic oligonucleotide
uucuauagaagaa

SEQ ID NO: 393 - RNA, 13 nt, Artificial Sequence
  synthetic oligonucleotide
uuguccagcaauu

SEQ ID NO: 394 - RNA, 13 nt, Artificial Sequence
  synthetic oligonucleotide
acauggaaagcga

SEQ ID NO: 395 - RNA, 13 nt, Artificial Sequence
  synthetic oligonucleotide
gcaguccagauua

SEQ ID NO: 396 - RNA, 13 nt, Artificial Sequence
  synthetic oligonucleotide
ugguugaaugugu

SEQ ID NO: 397 - RNA, 13 nt, Artificial Sequence
  synthetic oligonucleotide
uuaugaaacgagu

SEQ ID NO: 398 - RNA, 13 nt, Artificial Sequence
  synthetic oligonucleotide
caguccagauuau

SEQ ID NO: 399 - RNA, 13 nt, Artificial Sequence
  synthetic oligonucleotide
auauaagcggaaa

SEQ ID NO: 400 - RNA, 13 nt, Artificial Sequence
  synthetic oligonucleotide
uaccaguuaaaca

SEQ ID NO: 401 - RNA, 13 nt, Artificial Sequence
  synthetic oligonucleotide
uguucauucuaua

SEQ ID NO: 402 - RNA, 13 nt, Artificial Sequence
  synthetic oligonucleotide
ccgaccaaggaaa

SEQ ID NO: 403 - RNA, 13 nt, Artificial Sequence
  synthetic oligonucleotide
gaauggugcauac

SEQ ID NO: 404 - RNA, 13 nt, Artificial Sequence
  synthetic oligonucleotide
auaugauggccga

SEQ ID NO: 405 - RNA, 13 nt, Artificial Sequence
  synthetic oligonucleotide
agcaguccagauu

SEQ ID NO: 406 - RNA, 13 nt, Artificial Sequence
  synthetic oligonucleotide
gcauuuagucaaa

SEQ ID NO: 407 - RNA, 13 nt, Artificial Sequence
  synthetic oligonucleotide
agcauuccgaugu

SEQ ID NO: 408 - RNA, 13 nt, Artificial Sequence
  synthetic oligonucleotide
uagucaggaacuu

SEQ ID NO: 409 - RNA, 13 nt, Artificial Sequence
  synthetic oligonucleotide
ugcauuuagucaa

SEQ ID NO: 410 - RNA, 13 nt, Artificial Sequence
  synthetic oligonucleotide
gucugaugagucu

SEQ ID NO: 411 - RNA, 13 nt, Artificial Sequence
  synthetic oligonucleotide
uagacacauauga

SEQ ID NO: 412 - RNA, 13 nt, Artificial Sequence
  synthetic oligonucleotide
cagacgaggacau

SEQ ID NO: 413 - RNA, 13 nt, Artificial Sequence
  synthetic oligonucleotide
cagccgugaauuc

SEQ ID NO: 414 - RNA, 13 nt, Artificial Sequence
  synthetic oligonucleotide
agucuggaaauaa

SEQ ID NO: 415 - RNA, 13 nt, Artificial Sequence
  synthetic oligonucleotide
aguuuguggcuuc

SEQ ID NO: 416 - RNA, 13 nt, Artificial Sequence
  synthetic oligonucleotide
aguccaacgaaag

SEQ ID NO: 417 - RNA, 13 nt, Artificial Sequence
  synthetic oligonucleotide
aaguuucgcagac

SEQ ID NO: 418 - RNA, 13 nt, Artificial Sequence
  synthetic oligonucleotide
agcaaugagcauu

SEQ ID NO: 419 - RNA, 13 nt, Artificial Sequence
  synthetic oligonucleotide
uuagauagugcau

SEQ ID NO: 420 - RNA, 13 nt, Artificial Sequence
  synthetic oligonucleotide
uggugcauacaag

SEQ ID NO: 421 - RNA, 13 nt, Artificial Sequence
  synthetic oligonucleotide
augaaacgaguca

SEQ ID NO: 422 - RNA, 13 nt, Artificial Sequence
  synthetic oligonucleotide
ccagagugcugaa

SEQ ID NO: 423 - RNA, 13 nt, Artificial Sequence
  synthetic oligonucleotide
cagccaugaauuu

SEQ ID NO: 424 - RNA, 13 nt, Artificial Sequence
  synthetic oligonucleotide
auugguugaaugu

SEQ ID NO: 425 - RNA, 13 nt, Artificial Sequence
  synthetic oligonucleotide
gguugaaugugua

SEQ ID NO: 426 - RNA, 13 nt, Artificial Sequence
  synthetic oligonucleotide
ggaaauaacuaau

SEQ ID NO: 427 - RNA, 13 nt, Artificial Sequence
  synthetic oligonucleotide
ucaugaauagaaa

SEQ ID NO: 428 - RNA, 13 nt, Artificial Sequence
  synthetic oligonucleotide
gccagcaaccgaa

SEQ ID NO: 429 - RNA, 13 nt, Artificial Sequence
  synthetic oligonucleotide
caccucacacaug

SEQ ID NO: 430 - RNA, 13 nt, Artificial Sequence
  synthetic oligonucleotide
aguugaauggugc

SEQ ID NO: 431 - RNA, 13 nt, Artificial Sequence
  synthetic oligonucleotide
agucagcuggaug

SEQ ID NO: 432 - RNA, 13 nt, Artificial Sequence
  synthetic oligonucleotide
uauaagcggaaag

SEQ ID NO: 433 - RNA, 13 nt, Artificial Sequence
  synthetic oligonucleotide
uuccgaugugauu

SEQ ID NO: 434 - RNA, 13 nt, Artificial Sequence
  synthetic oligonucleotide
auaacuaaugugu

SEQ ID NO: 435 - RNA, 13 nt, Artificial Sequence
  synthetic oligonucleotide
ucauucuauagaa

SEQ ID NO: 436 - RNA, 13 nt, Artificial Sequence
  synthetic oligonucleotide
aacuaucacugua

SEQ ID NO: 437 - RNA, 13 nt, Artificial Sequence
  synthetic oligonucleotide
gucaauugcuuau

SEQ ID NO: 438 - RNA, 13 nt, Artificial Sequence
  synthetic oligonucleotide
agcaauuaauaaa

SEQ ID NO: 439 - RNA, 13 nt, Artificial Sequence
  synthetic oligonucleotide
acgacucugauga

SEQ ID NO: 440 - RNA, 13 nt, Artificial Sequence
  synthetic oligonucleotide
uagugugguuuau

SEQ ID NO: 441 - RNA, 13 nt, Artificial Sequence
  synthetic oligonucleotide
aagccaaugauga

SEQ ID NO: 442 - RNA, 13 nt, Artificial Sequence
  synthetic oligonucleotide
auagucaggaacu

SEQ ID NO: 443 - RNA, 13 nt, Artificial Sequence
  synthetic oligonucleotide
agucagccgugaa

SEQ ID NO: 444 - RNA, 13 nt, Artificial Sequence
  synthetic oligonucleotide
acuaccaugagaa

SEQ ID NO: 445 - RNA, 13 nt, Artificial Sequence
  synthetic oligonucleotide
aaacaggcugauu

SEQ ID NO: 446 - RNA, 13 nt, Artificial Sequence
  synthetic oligonucleotide
gagugcugaaacc

SEQ ID NO: 447 - RNA, 13 nt, Artificial Sequence
  synthetic oligonucleotide
ugagcauuccgau

SEQ ID NO: 448 - RNA, 13 nt, Artificial Sequence
  synthetic oligonucleotide
aauuccacagcca

SEQ ID NO: 449 - RNA, 13 nt, Artificial Sequence
  synthetic oligonucleotide
ugucaauugcuua

SEQ ID NO: 450 - RNA, 13 nt, Artificial Sequence
  synthetic oligonucleotide
accaugagaauug

SEQ ID NO: 451 - RNA, 13 nt, Artificial Sequence
  synthetic oligonucleotide
ccaacgaaagcca

SEQ ID NO: 452 - RNA, 13 nt, Artificial Sequence
  synthetic oligonucleotide
cuggucacugauu

SEQ ID NO: 453 - RNA, 13 nt, Artificial Sequence
  synthetic oligonucleotide
ugguuuauggacu

SEQ ID NO: 454 - RNA, 13 nt, Artificial Sequence
  synthetic oligonucleotide
gaccagagugcug

SEQ ID NO: 455 - RNA, 13 nt, Artificial Sequence
  synthetic oligonucleotide
gaugugauugaua

SEQ ID NO: 456 - RNA, 13 nt, Artificial Sequence
  synthetic oligonucleotide
gucagccgugaau

SEQ ID NO: 457 - RNA, 13 nt, Artificial Sequence
  synthetic oligonucleotide
aauguguaucuau

SEQ ID NO: 458 - RNA, 13 nt, Artificial Sequence
  synthetic oligonucleotide
uugagucuggaaa

SEQ ID NO: 459 - RNA, 13 nt, Artificial Sequence
  synthetic oligonucleotide
guccagcaauuaa

SEQ ID NO: 460 - RNA, 13 nt, Artificial Sequence
  synthetic oligonucleotide
ccagcaauuaaua

SEQ ID NO: 461 - RNA, 13 nt, Artificial Sequence
  synthetic oligonucleotide
gacucgaacgacu

SEQ ID NO: 462 - RNA, 13 nt, Artificial Sequence
  synthetic oligonucleotide
accugccagcaac

SEQ ID NO: 463 - DNA, 13 bp, Artificial Sequence
  synthetic oligonucleotide
actgaauaccaau

SEQ ID NO: 464 - RNA, 13 nt, Artificial Sequence
  synthetic oligonucleotide
acugaauaccaau

SEQ ID NO: 465 - RNA, 13 nt, Artificial Sequence
  synthetic oligonucleotide
cuguggaagucua

SEQ ID NO: 466 - RNA, 13 nt, Artificial Sequence
  synthetic oligonucleotide
ggcuacaaaaaca

SEQ ID NO: 467 - RNA, 15 nt, Artificial Sequence
  synthetic oligonucleotide
uuggcuacaaaaaca

SEQ ID NO: 468 - RNA, 17 nt, Artificial Sequence
  synthetic oligonucleotide
auuuggcuacaaaaaca

SEQ ID NO: 469 - RNA, 13 nt, Artificial Sequence
  synthetic oligonucleotide
uguaggaugucua

SEQ ID NO: 470 - RNA, 13 nt, Artificial Sequence
  synthetic oligonucleotide
aucuggagaaaca

SEQ ID NO: 471 - RNA, 15 nt, Artificial Sequence
  synthetic oligonucleotide
agaucuggagaaaca

SEQ ID NO: 472 - RNA, 13 nt, Artificial Sequence
  synthetic oligonucleotide
gacucaucugcua

SEQ ID NO: 473 - RNA, 13 nt, Artificial Sequence
  synthetic oligonucleotide
gacucaucugcua

SEQ ID NO: 474 - RNA, 15 nt, Artificial Sequence
  synthetic oligonucleotide
uggacucaucugcua

SEQ ID NO: 475 - RNA, 15 nt, Artificial Sequence
  synthetic oligonucleotide
uggacucaucugcua

SEQ ID NO: 476 - RNA, 13 nt, Artificial Sequence
  synthetic oligonucleotide
ggagaaacaacau

SEQ ID NO: 477 - RNA, 15 nt, Artificial Sequence
  synthetic oligonucleotide
cuggagaaacaacau

SEQ ID NO: 478 - RNA, 13 nt, Artificial Sequence
  synthetic oligonucleotide
agucccucaaaca

SEQ ID NO: 479 - RNA, 15 nt, Artificial Sequence
  synthetic oligonucleotide
agagucccucaaaca

SEQ ID NO: 480 - RNA, 13 nt, Artificial Sequence
  synthetic oligonucleotide
acugaauaccaau

SEQ ID NO: 481 - RNA, 13 nt, Artificial Sequence
  synthetic oligonucleotide
acugaauaccaau

SEQ ID NO: 482 - RNA, 15 nt, Artificial Sequence
  synthetic oligonucleotide
acacugaauaccaau

SEQ ID NO: 483 - RNA, 15 nt, Artificial Sequence
  synthetic oligonucleotide
acacugaauaccaau

SEQ ID NO: 484 - RNA, 13 nt, Artificial Sequence
  synthetic oligonucleotide
cuguggaagucua

SEQ ID NO: 485 - RNA, 13 nt, Artificial Sequence
  synthetic oligonucleotide
acaggaagaugua

SEQ ID NO: 486 - RNA, 13 nt, Artificial Sequence
  synthetic oligonucleotide
gaguggagcgccu

SEQ ID NO: 487 - RNA, 13 nt, Artificial Sequence
  synthetic oligonucleotide
cgacuggaagaca

SEQ ID NO: 488 - RNA, 13 nt, Artificial Sequence
  synthetic oligonucleotide
ggagcgccuguuc

SEQ ID NO: 489 - RNA, 13 nt, Artificial Sequence
  synthetic oligonucleotide
gccauuacaacug

SEQ ID NO: 490 - RNA, 13 nt, Artificial Sequence
  synthetic oligonucleotide
gagcuuucuggcu

SEQ ID NO: 491 - RNA, 13 nt, Artificial Sequence
  synthetic oligonucleotide
aguggagcgccug

SEQ ID NO: 492 - RNA, 13 nt, Artificial Sequence
  synthetic oligonucleotide
uggagcgccuguu

SEQ ID NO: 493 - RNA, 13 nt, Artificial Sequence
  synthetic oligonucleotide
guuugagcuuucu

SEQ ID NO: 494 - RNA, 13 nt, Artificial Sequence
  synthetic oligonucleotide
ugccauuacaacu

SEQ ID NO: 495 - RNA, 13 nt, Artificial Sequence
  synthetic oligonucleotide
acuggaagacacg

SEQ ID NO: 496 - RNA, 13 nt, Artificial Sequence
  synthetic oligonucleotide
aacugccuggucc

SEQ ID NO: 497 - RNA, 13 nt, Artificial Sequence
  synthetic oligonucleotide
agaccugugccug

SEQ ID NO: 498 - RNA, 13 nt, Artificial Sequence
  synthetic oligonucleotide
cagaguggagcgc

SEQ ID NO: 499 - RNA, 13 nt, Artificial Sequence
  synthetic oligonucleotide
ccugguccagacc

SEQ ID NO: 500 - RNA, 13 nt, Artificial Sequence
  synthetic oligonucleotide
ccauuacaacugu

SEQ ID NO: 501 - RNA, 13 nt, Artificial Sequence
  synthetic oligonucleotide
cugccauuacaac

SEQ ID NO: 502 - RNA, 13 nt, Artificial Sequence
  synthetic oligonucleotide
auuacaacugucc

SEQ ID NO: 503 - RNA, 13 nt, Artificial Sequence
  synthetic oligonucleotide
cauuacaacuguc

SEQ ID NO: 504 - RNA, 13 nt, Artificial Sequence
  synthetic oligonucleotide
agaguggagcgcc

SEQ ID NO: 505 - RNA, 13 nt, Artificial Sequence
  synthetic oligonucleotide
accgacuggaaga

SEQ ID NO: 506 - RNA, 13 nt, Artificial Sequence
  synthetic oligonucleotide
auguacggagaca

SEQ ID NO: 507 - RNA, 13 nt, Artificial Sequence
  synthetic oligonucleotide
gccuugcgaagcu

SEQ ID NO: 508 - RNA, 13 nt, Artificial Sequence
  synthetic oligonucleotide
gcugcgaggagug

SEQ ID NO: 509 - RNA, 13 nt, Artificial Sequence
  synthetic oligonucleotide
gccuaucaaguuu

SEQ ID NO: 510 - RNA, 13 nt, Artificial Sequence
  synthetic oligonucleotide
aauucuguggagu

SEQ ID NO: 511 - RNA, 13 nt, Artificial Sequence
  synthetic oligonucleotide
uguacggagacau

SEQ ID NO: 512 - RNA, 13 nt, Artificial Sequence
  synthetic oligonucleotide
agccuaucaaguu

SEQ ID NO: 513 - RNA, 13 nt, Artificial Sequence
  synthetic oligonucleotide
caaguuugagcuu

SEQ ID NO: 514 - RNA, 13 nt, Artificial Sequence
  synthetic oligonucleotide
cuguggaguaugu

SEQ ID NO: 515 - RNA, 13 nt, Artificial Sequence
  synthetic oligonucleotide
aaauucuguggag

SEQ ID NO: 516 - RNA, 13 nt, Artificial Sequence
  synthetic oligonucleotide
uuucaguagcaca

SEQ ID NO: 517 - RNA, 13 nt, Artificial Sequence
  synthetic oligonucleotide
caaugacaucuuu

SEQ ID NO: 518 - RNA, 13 nt, Artificial Sequence
  synthetic oligonucleotide
aguaccagugcac

SEQ ID NO: 519 - RNA, 13 nt, Artificial Sequence
  synthetic oligonucleotide
ggaagacacguuu

SEQ ID NO: 520 - RNA, 13 nt, Artificial Sequence
  synthetic oligonucleotide
cuaucaaguuuga

SEQ ID NO: 521 - RNA, 13 nt, Artificial Sequence
  synthetic oligonucleotide
agcuaaauucugu

SEQ ID NO: 522 - RNA, 13 nt, Artificial Sequence
  synthetic oligonucleotide
agguagaauguaa

SEQ ID NO: 523 - RNA, 13 nt, Artificial Sequence
  synthetic oligonucleotide
agcugaucaguuu

SEQ ID NO: 524 - RNA, 13 nt, Artificial Sequence
  synthetic oligonucleotide
uucugcucagaua

SEQ ID NO: 525 - RNA, 13 nt, Artificial Sequence
  synthetic oligonucleotide
uuaucuaaguuaa

SEQ ID NO: 526 - RNA, 13 nt, Artificial Sequence
  synthetic oligonucleotide
uauacgaguaaua

SEQ ID NO: 527 - RNA, 13 nt, Artificial Sequence
  synthetic oligonucleotide
gacuggacagcuu

SEQ ID NO: 528 - RNA, 13 nt, Artificial Sequence
  synthetic oligonucleotide
auggccuuuauua

SEQ ID NO: 529 - RNA, 13 nt, Artificial Sequence
  synthetic oligonucleotide
auaccgagcuaaa

SEQ ID NO: 530 - RNA, 13 nt, Artificial Sequence
  synthetic oligonucleotide
uuguugagagugu

SEQ ID NO: 531 - RNA, 13 nt, Artificial Sequence
  synthetic oligonucleotide
acauaccgagcua

SEQ ID NO: 532 - RNA, 13 nt, Artificial Sequence
  synthetic oligonucleotide
agcagaaagguua

SEQ ID NO: 533 - RNA, 13 nt, Artificial Sequence
  synthetic oligonucleotide
aguuguuccuuaa

SEQ ID NO: 534 - RNA, 13 nt, Artificial Sequence
  synthetic oligonucleotide
auuugaaguguaa

SEQ ID NO: 535 - RNA, 13 nt, Artificial Sequence
  synthetic oligonucleotide
aagcugaccugga

SEQ ID NO: 536 - RNA, 13 nt, Artificial Sequence
  synthetic oligonucleotide
ggucaugaagaag

SEQ ID NO: 537 - RNA, 13 nt, Artificial Sequence
  synthetic oligonucleotide
auggucaggccuu

SEQ ID NO: 538 - RNA, 13 nt, Artificial Sequence
  synthetic oligonucleotide
gaagacacguuug

SEQ ID NO: 539 - RNA, 13 nt, Artificial Sequence
  synthetic oligonucleotide
aggccuugcgaag

SEQ ID NO: 540 - RNA, 13 nt, Artificial Sequence
  synthetic oligonucleotide
uaccgacuggaag

SEQ ID NO: 541 - RNA, 13 nt, Artificial Sequence
  synthetic oligonucleotide
accgcaagaucgg

SEQ ID NO: 542 - RNA, 13 nt, Artificial Sequence
  synthetic oligonucleotide
caggccuugcgaa

SEQ ID NO: 543 - RNA, 13 nt, Artificial Sequence
  synthetic oligonucleotide
cgagcuaaauucu

SEQ ID NO: 544 - RNA, 13 nt, Artificial Sequence
  synthetic oligonucleotide
ucuguggaguaug

SEQ ID NO: 545 - RNA, 13 nt, Artificial Sequence
  synthetic oligonucleotide
cggagacauggca

SEQ ID NO: 546 - RNA, 13 nt, Artificial Sequence
  synthetic oligonucleotide
augacaacgccuc

SEQ ID NO: 547 - RNA, 13 nt, Artificial Sequence
  synthetic oligonucleotide
gaggucaugaaga

SEQ ID NO: 548 - RNA, 13 nt, Artificial Sequence
  synthetic oligonucleotide
uaaauucugugga

SEQ ID NO: 549 - RNA, 13 nt, Artificial Sequence
  synthetic oligonucleotide
uggaagacacguu

SEQ ID NO: 550 - RNA, 13 nt, Artificial Sequence
  synthetic oligonucleotide
aagauguacggag

SEQ ID NO: 551 - RNA, 13 nt, Artificial Sequence
  synthetic oligonucleotide
aaugacaacgccu

SEQ ID NO: 552 - RNA, 13 nt, Artificial Sequence
  synthetic oligonucleotide
ggcgaggucauga

SEQ ID NO: 553 - RNA, 13 nt, Artificial Sequence
  synthetic oligonucleotide
gacacguuuggcc

SEQ ID NO: 554 - RNA, 13 nt, Artificial Sequence
  synthetic oligonucleotide
acggagacauggc

SEQ ID NO: 555 - RNA, 13 nt, Artificial Sequence
  synthetic oligonucleotide
ucaggccuugcga

SEQ ID NO: 556 - RNA, 13 nt, Artificial Sequence
  synthetic oligonucleotide
gcgaagcugaccu

SEQ ID NO: 557 - RNA, 13 nt, Artificial Sequence
  synthetic oligonucleotide
ggaagauguacgg

SEQ ID NO: 558 - RNA, 13 nt, Artificial Sequence
  synthetic oligonucleotide
gugacuucggcuc

SEQ ID NO: 559 - RNA, 13 nt, Artificial Sequence
  synthetic oligonucleotide
ugacuucggcucc

SEQ ID NO: 560 - RNA, 13 nt, Artificial Sequence
  synthetic oligonucleotide
uggucaggccuug

SEQ ID NO: 561 - RNA, 13 nt, Artificial Sequence
  synthetic oligonucleotide
ucaaguuugagcu

SEQ ID NO: 562 - RNA, 13 nt, Artificial Sequence
  synthetic oligonucleotide
gccagaacugcag

SEQ ID NO: 563 - RNA, 13 nt, Artificial Sequence
  synthetic oligonucleotide
uggaguauguacc

SEQ ID NO: 564 - RNA, 13 nt, Artificial Sequence
  synthetic oligonucleotide
gcuagagaagcag

SEQ ID NO: 565 - RNA, 13 nt, Artificial Sequence
  synthetic oligonucleotide
ggucaggccuugc

SEQ ID NO: 566 - RNA, 13 nt, Artificial Sequence
  synthetic oligonucleotide
gagcuaaauucug

SEQ ID NO: 567 - RNA, 13 nt, Artificial Sequence
  synthetic oligonucleotide
aagacacguuugg

SEQ ID NO: 568 - RNA, 13 nt, Artificial Sequence
  synthetic oligonucleotide
cgaggucaugaag

SEQ ID NO: 569 - RNA, 13 nt, Artificial Sequence
  synthetic oligonucleotide
ggccuugcgaagc

SEQ ID NO: 570 - RNA, 13 nt, Artificial Sequence
  synthetic oligonucleotide
cuugcgaagcuga

SEQ ID NO: 571 - RNA, 13 nt, Artificial Sequence
  synthetic oligonucleotide
ccgacuggaagac

SEQ ID NO: 572 - RNA, 13 nt, Artificial Sequence
  synthetic oligonucleotide
ccuaucaaguuug

SEQ ID NO: 573 - RNA, 13 nt, Artificial Sequence
  synthetic oligonucleotide
uguuccaagaccu

SEQ ID NO: 574 - RNA, 13 nt, Artificial Sequence
  synthetic oligonucleotide
cgaagcugaccug

SEQ ID NO: 575 - RNA, 13 nt, Artificial Sequence
  synthetic oligonucleotide
uugcgaagcugac

SEQ ID NO: 576 - RNA, 13 nt, Artificial Sequence
  synthetic oligonucleotide
caaugacaacgcc

SEQ ID NO: 577 - RNA, 13 nt, Artificial Sequence
  synthetic oligonucleotide
guaccagugcacg

SEQ ID NO: 578 - RNA, 13 nt, Artificial Sequence
  synthetic oligonucleotide
ccuguuccaagac

SEQ ID NO: 579 - RNA, 13 nt, Artificial Sequence
  synthetic oligonucleotide
uacggagacaugg

SEQ ID NO: 580 - RNA, 13 nt, Artificial Sequence
  synthetic oligonucleotide
ugcgaagcugacc

SEQ ID NO: 581 - RNA, 13 nt, Artificial Sequence
  synthetic oligonucleotide
ccuugcgaagcug

SEQ ID NO: 582 - RNA, 13 nt, Artificial Sequence
  synthetic oligonucleotide
cugugacuucggc

SEQ ID NO: 583 - RNA, 13 nt, Artificial Sequence
  synthetic oligonucleotide
gcuaaauucugug

SEQ ID NO: 584 - RNA, 13 nt, Artificial Sequence
  synthetic oligonucleotide
cuaaauucugugg

SEQ ID NO: 585 - RNA, 13 nt, Artificial Sequence
  synthetic oligonucleotide
agacacguuuggc

SEQ ID NO: 586 - RNA, 13 nt, Artificial Sequence
  synthetic oligonucleotide
ccgcaagaucggc

SEQ ID NO: 587 - RNA, 13 nt, Artificial Sequence
  synthetic oligonucleotide
uaucaaguuugag

SEQ ID NO: 588 - RNA, 13 nt, Artificial Sequence
  synthetic oligonucleotide
gaagcugaccugg

SEQ ID NO: 589 - RNA, 13 nt, Artificial Sequence
  synthetic oligonucleotide
gcauuuagucaaa

SEQ ID NO: 590 - RNA, 13 nt, Artificial Sequence
  synthetic oligonucleotide
ggcuacaaaaaca

SEQ ID NO: 591 - RNA, 15 nt, Artificial Sequence
  synthetic oligonucleotide
uuggcuacaaaaaca

SEQ ID NO: 592 - RNA, 17 nt, Artificial Sequence
  synthetic oligonucleotide
auuuggcuacaaaaaca

SEQ ID NO: 593 - RNA, 13 nt, Artificial Sequence
  synthetic oligonucleotide
acaaauacgauuu

SEQ ID NO: 594 - RNA, 13 nt, Artificial Sequence
  synthetic oligonucleotide
acaaauacgauuu

SEQ ID NO: 595 - RNA, 25 nt, Artificial Sequence
  synthetic oligonucleotide
cuuugaagaguucuguggaagucua

SEQ ID NO: 596 - RNA, 23 nt, Artificial Sequence
  synthetic oligonucleotide
acaaacaccauugucacacucca

SEQ ID NO: 597 - RNA, 19 nt, Artificial sequence
  synthetic oligonucleotide
uagacuuccacagaacucu

SEQ ID NO: 598 - RNA, 13 nt, Artificial sequence
  synthetic oligonucleotide
cuguggaagucua

SEQ ID NO: 599 - RNA, 32 nt, Artificial sequence
  synthetic oligonuclotide
uagacuuccacagaacucugacaccuucagau

SEQ ID NO: 600 - RNA, 13 nt, Artificial sequence
  synthetic oligonucleotide
uagacuuccacag

SEQ ID NO: 601 - RNA, 13 nt, Artificial sequence
  synthetic oligonucleotide
cuguggaagucua

SEQ ID NO: 602 - RNA, 31 nt, Artificial sequence
  synthetic oligonucleotide
uagacuuccacagaacucuuguggaagucua

SEQ ID NO: 603 - RNA, 31 nt, Artificial sequence; identical to SEQ ID NO: 602
  synthetic oligonucleotide

SEQ ID NO: 604 - RNA, 25 nt, Artificial sequence
  synthetic oligonucleotide
cuuugaagaguucuguggaagucua

SEQ ID NO: 605 - RNA, 25 nt, Artificial sequence
  synthetic oligonucleotide
uagacuuccacagaacucuucaaag

SEQ ID NO: 606 - RNA, 31 nt, Artificial sequence
  synthetic oligonucleotide
uagacuuccacagaacuucuguggaagucua

SEQ ID NO: 607 - RNA, 31 nt, Artificial sequence; identical to SEQ ID NO: 606
  synthetic oligonucleotide

SEQ ID NO: 608 - RNA, 13 nt, Artificial sequence
  synthetoc oligonucleotide
uacuuucuucauu

SEQ ID NO: 609 - RNA, 13 nt, Artificial sequence
  synthetic oligonucleotide
aaugaagaaagua

SEQ ID NO: 610 - RNA, 32 nt, Artificial sequence
  synthetic oligonucleotide
uacuuucuucauuuccaccaaugaagaaagua

SEQ ID NO: 611 - RNA, 32 nt, Artificial sequence; identical to SEQ ID NO: 610
  synthetic oligonucleotide

SEQ ID NO: 612 - RNA, 19 nt, Artificial sequence
  synthetic oligonucleotide
uacuuucuucauuuccacc

SEQ ID NO: 613 - RNA, 13 nt, Artificial sequence
  synthetic oligonucleotide
aaugaagaaagua

SEQ ID NO: 614 - RNA, 25 nt, Artificial sequence
  synthetic oligonucleotide
uacuuucuucauuuccaccuuugcc

SEQ ID NO: 615 - RNA, 25 nt, Artificial sequence
  synthetic oligonucleotide
ggcaaagguggaaaugaagaaagua

SEQ ID NO: 616 - RNA, 19 nt, Artificial Sequence
  synthetic oligonucleotide
ucuaauucaugagaaauac

SEQ ID NO: 617 - RNA, 19 nt, Artificial Sequence
  synthetic oligonucleotide
uaauugaccucagaagaug

SEQ ID NO: 618 - RNA, 19 nt, Artificial Sequence
  synthetic oligonucleotide
uuuaauugaccucagaaga

SEQ ID NO: 619 - RNA, 19 nt, Artificial Sequence
  synthetic oligonucleotide
aauugaccucagaagaugc

SEQ ID NO: 620 - RNA, 19 nt, Artificial Sequence
  synthetic oligonucleotide
uuaauugaccucagaagau

SEQ ID NO: 621 - RNA, 19 nt, Artificial Sequence
  synthetic oligonucleotide
auugaccucagaagaugca

SEQ ID NO: 622 - RNA, 19 nt, Artificial Sequence
  synthetic oligonucleotide
ucauccagcugacucguuu

SEQ ID NO: 623 - RNA, 19 nt, Artificial Sequence
  synthetic oligonucleotide
agauucaucagaaugguga

SEQ ID NO: 624 - RNA, 19 nt, Artificial Sequence
  synthetic oligonucleotide
ugaccucaguccauaaacc

SEQ ID NO: 625 - RNA, 19 nt, Artificial Sequence
  synthetic oligonucleotide
aauggugagacucaucaga

SEQ ID NO: 626 - RNA, 19 nt, Artificial Sequence
  synthetic oligonucleotide
uuugaccucaguccauaaa

SEQ ID NO: 627 - RNA, 19 nt, Artificial Sequence
  synthetic oligonucleotide
uucauggcugugaaauuca

SEQ ID NO: 628 - RNA, 19 nt, Artificial Sequence
  synthetic oligonucleotide
gaauggugagacucaucag

SEQ ID NO: 629 - RNA, 19 nt, Artificial Sequence
  synthetic oligonucleotide
uggcuuuccgcuuauauaa

SEQ ID NO: 630 - RNA, 19 nt, Artificial Sequence
  synthetic oligonucleotide
uuggcuuuccgcuuauaua

SEQ ID NO: 631 - RNA, 19 nt, Artificial Sequence
  synthetic oligonucleotide
ucauccauguggucauggc

SEQ ID NO: 632 - RNA, 19 nt, Artificial Sequence
  synthetic oligonucleotide
auguggucauggcuuucgu

SEQ ID NO: 633 - RNA, 19 nt, Artificial Sequence
  synthetic oligonucleotide
guggucauggcuuucguug

SEQ ID NO: 634 - RNA, 19 nt, Artificial Sequence
  synthetic oligonucleotide
auuggcuuuccgcuuauau

SEQ ID NO: 635 - RNA, 19 nt, Artificial Sequence
  synthetic oligonucleotide
aaauacgaaauuucaggug

SEQ ID NO: 636 - RNA, 19 nt, Artificial Sequence
  synthetic oligonucleotide
agaaauacgaaauuucagg

SEQ ID NO: 637 - RNA, 19 nt, Artificial Sequence
  synthetic oligonucleotide
uggucauggcuuucguugg

SEQ ID NO: 638 - RNA, 19 nt, Artificial Sequence
  synthetic oligonucleotide
auaucauccauguggucau

SEQ ID NO: 639 - RNA, 19 nt, Artificial Sequence
  synthetic oligonucleotide
aauacgaaauuucaggugu

SEQ ID NO: 640 - RNA, 19 nt, Artificial Sequence
  synthetic oligonucleotide
aaucagaaggcgcguucag

SEQ ID NO: 641 - RNA, 19 nt, Artificial Sequence
  synthetic oligonucleotide
auucaugagaaauacgaaa

SEQ ID NO: 642 - RNA, 19 nt, Artificial Sequence
  synthetic oligonucleotide
cuauucaugagagaauaac

SEQ ID NO: 643 - RNA, 19 nt, Artificial Sequence
  synthetic oligonucleotide
uuucguuggacuuacuugg

SEQ ID NO: 644 - RNA, 19 nt, Artificial Sequence
  synthetic oligonucleotide
uugcucucaucauuggcuu

SEQ ID NO: 645 - RNA, 19 nt, Artificial Sequence
  synthetic oligonucleotide
uucaacuccucgcuuucca

SEQ ID NO: 646 - RNA, 19 nt, Artificial Sequence
  synthetic oligonucleotide
ugacuaucaaucacaucgg

SEQ ID NO: 647 - RNA, 19 nt, Artificial Sequence
  synthetic oligonucleotide
agaugcacuaucuaauuca

SEQ ID NO: 648 - RNA, 19 nt, Artificial Sequence
  synthetic oligonucleotide
aauagauacacauucaacc

SEQ ID NO: 649 - RNA, 19 nt, Artificial Sequence
  synthetic oligonucleotide
uucuucuauagaaugaaca

SEQ ID NO: 650 - RNA, 19 nt, Artificial Sequence
  synthetic oligonucleotide
aauugcuggacaaccgugg

SEQ ID NO: 651 - RNA, 19 nt, Artificial Sequence
  synthetic oligonucleotide
ucgcuuuccaugugugagg

SEQ ID NO: 652 - RNA, 19 nt, Artificial Sequence
  synthetic oligonucleotide
uaaucuggacugcuugugg

SEQ ID NO: 653 - RNA, 19 nt, Artificial Sequence
  synthetic oligonucleotide
acacauucaaccaauaaac

SEQ ID NO: 654 - RNA, 19 nt, Artificial Sequence
  synthetic oligonucleotide
acucguuucauaacugucc

SEQ ID NO: 655 - RNA, 19 nt, Artificial Sequence
  synthetic oligonucleotide
auaaucuggacugcuugug

SEQ ID NO: 656 - RNA, 19 nt, Artificial Sequence
  synthetic oligonucleotide
uuuccgcuuauauaaucug

SEQ ID NO: 657 - RNA, 19 nt, Artificial Sequence
  synthetic oligonucleotide
uguuuaacugguauggcac

SEQ ID NO: 658 - RNA, 19 nt, Artificial Sequence
  synthetic oligonucleotide
uauagaaugaacauagaca

SEQ ID NO: 659 - RNA, 19 nt, Artificial Sequence
  synthetic oligonucleotide
uuuccuuggucggcguuug

SEQ ID NO: 660 - RNA, 19 nt, Artificial Sequence
  synthetic oligonucleotide
guaugcaccauucaacucc

SEQ ID NO: 661 - RNA, 19 nt, Artificial Sequence
  synthetic oligonucleotide
ucggccaucauaugugucu

SEQ ID NO: 662 - RNA, 19 nt, Artificial Sequence
  synthetic oligonucleotide
aaucuggacugcuuguggc

SEQ ID NO: 663 - RNA, 19 nt, Artificial Sequence
  synthetic oligonucleotide
acaucggaaugcucauugc

SEQ ID NO: 664 - RNA, 19 nt, Artificial Sequence
  synthetic oligonucleotide
aaguuccugacuaucaauc

SEQ ID NO: 665 - RNA, 19 nt, Artificial Sequence
  synthetic oligonucleotide
uugacuaaaugcaaaguga

SEQ ID NO: 666 - RNA, 19 nt, Artificial Sequence
  synthetic oligonucleotide
agacucaucagacugguga

SEQ ID NO: 667 - RNA, 19 nt, Artificial Sequence
  synthetic oligonucleotide
ucauaugugucuacugugg

SEQ ID NO: 668 - RNA, 19 nt, Artificial Sequence
  synthetic oligonucleotide
auguccucgucuguagcau

SEQ ID NO: 669 - RNA, 19 nt, Artificial Sequence
  synthetic oligonucleotide
gaauucacggcugacuuug

SEQ ID NO: 670 - RNA, 19 nt, Artificial Sequence
  synthetic oligonucleotide
uuauuuccagacucaaaua

SEQ ID NO: 671 - RNA, 19 nt, Artificial Sequence
  synthetic oligonucleotide
gaagccacaaacuaaacua

SEQ ID NO: 672 - RNA, 19 nt, Artificial Sequence
  synthetic oligonucleotide
cuuucguuggacuuacuug

SEQ ID NO: 673 - RNA, 19 nt, Artificial Sequence
  synthetic oligonucleotide
gucugcgaaacuucuuaga

SEQ ID NO: 674 - RNA, 19 nt, Artificial Sequence
  synthetic oligonucleotide
aaugcucauugcucucauc

SEQ ID NO: 675 - RNA, 19 nt, Artificial Sequence
  synthetic oligonucleotide
augcacuaucuaauucaug

SEQ ID NO: 676 - RNA, 19 nt, Artificial Sequence
  synthetic oligonucleotide
cuuguaugcaccauucaac

SEQ ID NO: 677 - RNA, 19 nt, Artificial Sequence
  synthetic oligonucleotide
ugacucguuucauaacugu

SEQ ID NO: 678 - RNA, 19 nt, Artificial Sequence
  synthetic oligonucleotide
uucagcacucuggucaucc

SEQ ID NO: 679 - RNA, 19 nt, Artificial Sequence
  synthetic oligonucleotide
aaauucauggcuguggaau

SEQ ID NO: 680 - RNA, 19 nt, Artificial Sequence
  synthetic oligonucleotide
acauucaaccaauaaacug

SEQ ID NO: 681 - RNA, 19 nt, Artificial Sequence
  synthetic oligonucleotide
uacacauucaaccaauaaa

SEQ ID NO: 682 - RNA, 19 nt, Artificial Sequence
  synthetic oligonucleotide
auuaguuauuuccagacuc

SEQ ID NO: 683 - RNA, 19 nt, Artificial Sequence
  synthetic oligonucleotide
uuucuauucaugagagaau

SEQ ID NO: 684 - RNA, 19 nt, Artificial Sequence
  synthetic oligonucleotide
uucgguugcuggcaggucc

SEQ ID NO: 685 - RNA, 19 nt, Artificial Sequence
  synthetic oligonucleotide
caugugugaggugaugucc

SEQ ID NO: 686 - RNA, 19 nt, Artificial Sequence
  synthetic oligonucleotide
gcaccauucaacuccucgc

SEQ ID NO: 687 - RNA, 19 nt, Artificial Sequence
  synthetic oligonucleotide
cauccagcugacucguuuc

SEQ ID NO: 688 - RNA, 19 nt, Artificial Sequence
  synthetic oligonucleotide
cuuuccgcuuauauaaucu

SEQ ID NO: 689 - RNA, 19 nt, Artificial Sequence
  synthetic oligonucleotide
aaucacaucggaaugcuca

SEQ ID NO: 690 - RNA, 19 nt, Artificial Sequence
  synthetic oligonucleotide
acacauuaguuauuuccag

SEQ ID NO: 691 - RNA, 19 nt, Artificial Sequence
  synthetic oligonucleotide
uucuauagaaugaacauag

SEQ ID NO: 692 - RNA, 19 nt, Artificial Sequence
  synthetic oligonucleotide
uacagugauaguuugcauu

SEQ ID NO: 693 - RNA, 19 nt, Artificial Sequence
  synthetic oligonucleotide
auaagcaauugacaccacc

SEQ ID NO: 694 - RNA, 19 nt, Artificial Sequence
  synthetic oligonucleotide
uuuauuaauugcuggacaa

SEQ ID NO: 695 - RNA, 19 nt, Artificial Sequence
  synthetic oligonucleotide
ucaucagagucguucgagu

SEQ ID NO: 696 - RNA, 19 nt, Artificial Sequence
  synthetic oligonucleotide
auaaaccacacuaucaccu

SEQ ID NO: 697 - RNA, 19 nt, Artificial Sequence
  synthetic oligonucleotide
ucaucauuggcuuuccgcu

SEQ ID NO: 698 - RNA, 19 nt, Artificial Sequence
  synthetic oligonucleotide
aguuccugacuaucaauca

SEQ ID NO: 699 - RNA, 19 nt, Artificial Sequence
  synthetic oligonucleotide
uucacggcugacuuuggaa

SEQ ID NO: 700 - RNA, 19 nt, Artificial Sequence
  synthetic oligonucleotide
uucucaugguagugaguuu

SEQ ID NO: 701 - RNA, 19 nt, Artificial Sequence
  synthetic oligonucleotide
aaucagccuguuuaacugg

SEQ ID NO: 702 - RNA, 19 nt, Artificial Sequence
  synthetic oligonucleotide
gguuucagcacucugguca

SEQ ID NO: 703 - RNA, 19 nt, Artificial Sequence
  synthetic oligonucleotide
aucggaaugcucauugcuc

SEQ ID NO: 704 - RNA, 19 nt, Artificial Sequence
  synthetic oligonucleotide
uggcuguggaauucacggc

SEQ ID NO: 705 - RNA, 19 nt, Artificial Sequence
  synthetic oligonucleotide
uaagcaauugacaccacca

SEQ ID NO: 706 - RNA, 19 nt, Artificial Sequence
  synthetic oligonucleotide
caauucucaugguagugag

SEQ ID NO: 707 - RNA, 19 nt, Artificial Sequence
  synthetic oligonucleotide
uggcuuucguuggacuuac

SEQ ID NO: 708 - RNA, 19 nt, Artificial Sequence
  synthetic oligonucleotide
aaucagugaccaguucauc

SEQ ID NO: 709 - RNA, 19 nt, Artificial Sequence
  synthetic oligonucleotide
aguccauaaaccacacuau

SEQ ID NO: 710 - RNA, 19 nt, Artificial Sequence
  synthetic oligonucleotide
cagcacucuggucauccag

SEQ ID NO: 711 - RNA, 19 nt, Artificial Sequence
  synthetic oligonucleotide
uaucaaucacaucggaaug

SEQ ID NO: 712 - RNA, 19 nt, Artificial Sequence
  synthetic oligonucleotide
auucacggcugacuuugga

SEQ ID NO: 713 - RNA, 19 nt, Artificial Sequence
  synthetic oligonucleotide
auagauacacauucaacca

SEQ ID NO: 714 - RNA, 19 nt, Artificial Sequence
  synthetic oligonucleotide
uuuccagacucaaauagau

SEQ ID NO: 715 - RNA, 19 nt, Artificial Sequence
  synthetic oligonucleotide
uuaauugcuggacaaccgu

SEQ ID NO: 716 - RNA, 19 nt, Artificial Sequence
  synthetic oligonucleotide
uauuaauugcuggacaacc

SEQ ID NO: 717 - RNA, 19 nt, Artificial Sequence
  synthetic oligonucleotide
agucguucgagucaaugga

SEQ ID NO: 718 - RNA, 19 nt, Artificial Sequence
  synthetic oligonucleotide
guugcuggcagguccgugg

SEQ ID NO: 719 - RNA, 13 nt, Artificial Sequence
  synthetic oligonucleotide
cucaugaauuaga

SEQ ID NO: 720 - RNA, 13 nt, Artificial Sequence
  synthetic oligonucleotide
cugaggucaauua

SEQ ID NO: 721 - RNA, 13 nt, Artificial Sequence
  synthetic oligonucleotide
gaggucaauuaaa

SEQ ID NO: 722 - RNA, 13 nt, Artificial Sequence
  synthetic oligonucleotide
ucugaggucaauu

SEQ ID NO: 723 - RNA, 13 nt, Artificial Sequence
  synthetic oligonucleotide
ugaggucaauuaa

SEQ ID NO: 724 - RNA, 13 nt, Artificial Sequence
  synthetic oligonucleotide
uucugaggucaau

SEQ ID NO: 725 - RNA, 13 nt, Artificial Sequence
  synthetic oligonucleotide
gucagcuggauga

SEQ ID NO: 726 - RNA, 13 nt, Artificial Sequence
  synthetic oligonucleotide
uucugaugaaucu

SEQ ID NO: 727 - RNA, 13 nt, Artificial Sequence
  synthetic oligonucleotide
uggacugagguca

SEQ ID NO: 728 - RNA, 13 nt, Artificial Sequence
  synthetic oligonucleotide
gagucucaccauu

SEQ ID NO: 729 - RNA, 13 nt, Artificial Sequence
  synthetic oligonucleotide
gacugaggucaaa

SEQ ID NO: 730 - RNA, 13 nt, Artificial Sequence
  synthetic oligonucleotide
ucacagccaugaa

SEQ ID NO: 731 - RNA, 13 nt, Artificial Sequence
  synthetic oligonucleotide
agucucaccauuc

SEQ ID NO: 732 - RNA, 13 nt, Artificial Sequence
  synthetic oligonucleotide
aagcggaaagcca

SEQ ID NO: 733 - RNA, 13 nt, Artificial Sequence
  synthetic oligonucleotide
agcggaaagccaa

SEQ ID NO: 734 - RNA, 13 nt, Artificial Sequence
  synthetic oligonucleotide
accacauggauga

SEQ ID NO: 735 - RNA, 13 nt, Artificial Sequence
  synthetic oligonucleotide
gccaugaccacau

SEQ ID NO: 736 - RNA, 13 nt, Artificial Sequence
  synthetic oligonucleotide
aagccaugaccac

SEQ ID NO: 737 - RNA, 13 nt, Artificial Sequence
  synthetic oligonucleotide
gcggaaagccaau

SEQ ID NO: 738 - RNA, 13 nt, Artificial Sequence
  synthetic oligonucleotide
aaauuucguauuu

SEQ ID NO: 739 - RNA, 13 nt, Artificial Sequence
  synthetic oligonucleotide
auuucguauuucu

SEQ ID NO: 740 - RNA, 13 nt, Artificial Sequence
  synthetic oligonucleotide
aaagccaugacca

SEQ ID NO: 741 - RNA, 13 nt, Artificial Sequence
  synthetic oligonucleotide
acauggaugauau

SEQ ID NO: 742 - RNA, 13 nt, Artificial Sequence
  synthetic oligonucleotide
gaaauuucguauu

SEQ ID NO: 743 - RNA, 13 nt, Artificial Sequence
  synthetic oligonucleotide
gcgccuucugauu

SEQ ID NO: 744 - RNA, 13 nt, Artificial Sequence
  synthetic oligonucleotide
auuucucaugaau

SEQ ID NO: 745 - RNA, 13 nt, Artificial Sequence
  synthetic oligonucleotide
cucucaugaauag

SEQ ID NO: 746 - RNA, 13 nt, Artificial Sequence
  synthetic oligonucleotide
aaguccaacgaaa

SEQ ID NO: 747 - RNA, 13 nt, Artificial Sequence
  synthetic oligonucleotide
augaugagagcaa

SEQ ID NO: 748 - RNA, 13 nt, Artificial Sequence
  synthetic oligonucleotide
gcgaggaguugaa

SEQ ID NO: 749 - RNA, 13 nt, Artificial Sequence
  synthetic oligonucleotide
ugauugauaguca

SEQ ID NO: 750 - RNA, 13 nt, Artificial Sequence
  synthetic oligonucleotide
agauagugcaucu

SEQ ID NO: 751 - RNA, 13 nt, Artificial Sequence
  synthetic oligonucleotide
auguguaucuauu

SEQ ID NO: 752 - RNA, 13 nt, Artificial Sequence
  synthetic oligonucleotide
uucuauagaagaa

SEQ ID NO: 753 - RNA, 13 nt, Artificial Sequence
  synthetic oligonucleotide
uuguccagcaauu

SEQ ID NO: 754 - RNA, 13 nt, Artificial Sequence
  synthetic oligonucleotide
acauggaaagcga

SEQ ID NO: 755 - RNA, 13 nt, Artificial Sequence
  synthetic oligonucleotide
gcaguccagauua

SEQ ID NO: 756 - RNA, 13 nt, Artificial Sequence
  synthetic oligonucleotide
ugguugaaugugu

SEQ ID NO: 757 - RNA, 13 nt, Artificial Sequence
  synthetic oligonucleotide
uuaugaaacgagu

SEQ ID NO: 758 - RNA, 13 nt, Artificial Sequence
  synthetic oligonucleotide
caguccagauuau

SEQ ID NO: 759 - RNA, 13 nt, Artificial Sequence
  synthetic oligonucleotide
auauaagcggaaa

SEQ ID NO: 760 - RNA, 13 nt, Artificial Sequence
  synthetic oligonucleotide
uaccaguuaaaca

SEQ ID NO: 761 - RNA, 13 nt, Artificial Sequence
  synthetic oligonucleotide
uguucauucuaua

SEQ ID NO: 762 - RNA, 13 nt, Artificial Sequence
  synthetic oligonucleotide
ccgaccaaggaaa

SEQ ID NO: 763 - RNA, 13 nt, Artificial Sequence
  synthetic oligonucleotide
gaauggugcauac

SEQ ID NO: 764 - RNA, 13 nt, Artificial Sequence
  synthetic oligonucleotide
auaugauggccga

SEQ ID NO: 765 - RNA, 13 nt, Artificial Sequence
  synthetic oligonucleotide
agcaguccagauu

SEQ ID NO: 766 - RNA, 13 nt, Artificial Sequence
  synthetic oligonucleotide
agcauuccgaugu

SEQ ID NO: 767 - RNA, 13 nt, Artificial Sequence
  synthetic oligonucleotide
uagucaggaacuu

SEQ ID NO: 768 - RNA, 13 nt, Artificial Sequence
  synthetic oligonucleotide
ugcauuuagucaa

SEQ ID NO: 769 - RNA, 13 nt, Artificial Sequence
  synthetic oligonucleotide
gucugaugagucu

SEQ ID NO: 770 - RNA, 13 nt, Artificial Sequence
  synthetic oligonucleotide
uagacacauauga

SEQ ID NO: 771 - RNA, 13 nt, Artificial Sequence
  synthetic oligonucleotide
cagacgaggacau

SEQ ID NO: 772 - RNA, 13 nt, Artificial Sequence
  synthetic oligonucleotide
cagccgugaauuc

SEQ ID NO: 773 - RNA, 13 nt, Artificial Sequence
  synthetic oligonucleotide
agucuggaaauaa

SEQ ID NO: 774 - RNA, 13 nt, Artificial Sequence
  synthetic oligonucleotide
aguuuguggcuuc

SEQ ID NO: 775 - RNA, 13 nt, Artificial Sequence
  synthetic oligonucleotide
aguccaacgaaag

SEQ ID NO: 776 - RNA, 13 nt, Artificial Sequence
  synthetic oligonucleotide
aaguuucgcagac

SEQ ID NO: 777 - RNA, 13 nt, Artificial Sequence
  synthetic oligonucleotide
agcaaugagcauu

SEQ ID NO: 778 - RNA, 13 nt, Artificial Sequence
  synthetic oligonucleotide
uuagauagugcau

SEQ ID NO: 779 - RNA, 13 nt, Artificial Sequence
  synthetic oligonucleotide
uggugcauacaag

SEQ ID NO: 780 - RNA, 13 nt, Artificial Sequence
  synthetic oligonucleotide
augaaacgaguca

SEQ ID NO: 781 - RNA, 13 nt, Artificial Sequence
  synthetic oligonucleotide
ccagagugcugaa

SEQ ID NO: 782 - RNA, 13 nt, Artificial Sequence
  synthetic oligonucleotide
cagccaugaauuu

SEQ ID NO: 783 - RNA, 13 nt, Artificial Sequence
  synthetic oligonucleotide
auugguugaaugu

SEQ ID NO: 784 - RNA, 13 nt, Artificial Sequence
  synthetic oligonucleotide
gguugaaugugua

SEQ ID NO: 785 - RNA, 13 nt, Artificial Sequence
  synthetic oligonucleotide
ggaaauaacuaau

SEQ ID NO: 786 - RNA, 13 nt, Artificial Sequence
  synthetic oligonucleotide
ucaugaauagaaa

SEQ ID NO: 787 - RNA, 13 nt, Artificial Sequence
  synthetic oligonucleotide
gccagcaaccgaa

SEQ ID NO: 788 - RNA, 13 nt, Artificial Sequence
  synthetic oligonucleotide
caccucacacaug

SEQ ID NO: 789 - RNA, 13 nt, Artificial Sequence
  synthetic oligonucleotide
aguugaauggugc

SEQ ID NO: 790 - RNA, 13 nt, Artificial Sequence
  synthetic oligonucleotide
agucagcuggaug

SEQ ID NO: 791 - RNA, 13 nt, Artificial Sequence
  synthetic oligonucleotide
uauaagcggaaag

SEQ ID NO: 792 - RNA, 13 nt, Artificial Sequence
  synthetic oligonucleotide
uuccgaugugauu

SEQ ID NO: 793 - RNA, 13 nt, Artificial Sequence
  synthetic oligonucleotide
auaacuaaugugu

SEQ ID NO: 794 - RNA, 13 nt, Artificial Sequence
  synthetic oligonucleotide
ucauucuauagaa

SEQ ID NO: 795 - RNA, 13 nt, Artificial Sequence
  synthetic oligonucleotide
aacuaucacugua

SEQ ID NO: 796 - RNA, 13 nt, Artificial Sequence
  synthetic oligonucleotide
gucaauugcuuau

SEQ ID NO: 797 - RNA, 13 nt, Artificial Sequence
  synthetic oligonucleotide
agcaauuaauaaa

SEQ ID NO: 798 - RNA, 13 nt, Artificial Sequence
  synthetic oligonucleotide
acgacucugauga

SEQ ID NO: 799 - RNA, 13 nt, Artificial Sequence
  synthetic oligonucleotide
uagugugguuuau

SEQ ID NO: 800 - RNA, 13 nt, Artificial Sequence
  synthetic oligonucleotide
aagccaaugauga

SEQ ID NO: 801 - RNA, 13 nt, Artificial Sequence
  synthetic oligonucleotide
auagucaggaacu

SEQ ID NO: 802 - RNA, 13 nt, Artificial Sequence
  synthetic oligonucleotide
agucagccgugaa

SEQ ID NO: 803 - RNA, 13 nt, Artificial Sequence
  synthetic oligonucleotide
acuaccaugagaa

SEQ ID NO: 804 - RNA, 13 nt, Artificial Sequence
  synthetic oligonucleotide
aaacaggcugauu

SEQ ID NO: 805 - RNA, 13 nt, Artificial Sequence
  synthetic oligonucleotide
gagugcugaaacc

SEQ ID NO: 806 - RNA, 13 nt, Artificial Sequence
  synthetic oligonucleotide
ugagcauuccgau

SEQ ID NO: 807 - RNA, 13 nt, Artificial Sequence
  synthetic oligonucleotide
aauuccacagcca

SEQ ID NO: 808 - RNA, 13 nt, Artificial Sequence
  synthetic oligonucleotide
ugucaauugcuua

SEQ ID NO: 809 - RNA, 13 nt, Artificial Sequence
  synthetic oligonucleotide
accaugagaauug

SEQ ID NO: 810 - RNA, 13 nt, Artificial Sequence
  synthetic oligonucleotide
ccaacgaaagcca

SEQ ID NO: 811 - RNA, 13 nt, Artificial Sequence
  synthetic oligonucleotide
cuggucacugauu

SEQ ID NO: 812 - RNA, 13 nt, Artificial Sequence
  synthetic oligonucleotide
ugguuuauggacu

SEQ ID NO: 813 - RNA, 13 nt, Artificial Sequence
  synthetic oligonucleotide
gaccagagugcug

SEQ ID NO: 814 - RNA, 13 nt, Artificial Sequence
  synthetic oligonucleotide
gaugugauugaua

SEQ ID NO: 815 - RNA, 13 nt, Artificial Sequence
  synthetic oligonucleotide
gucagccgugaau

SEQ ID NO: 816 - RNA, 13 nt, Artificial Sequence
  synthetic oligonucleotide
aauguguaucuau

SEQ ID NO: 817 - RNA, 13 nt, Artificial Sequence
  synthetic oligonucleotide
uugagucuggaaa

SEQ ID NO: 818 - RNA, 13 nt, Artificial Sequence
  synthetic oligonucleotide
guccagcaauuaa

SEQ ID NO: 819 - RNA, 13 nt, Artificial Sequence
  synthetic oligonucleotide
ccagcaauuaaua

SEQ ID NO: 820 - RNA, 13 nt, Artificial Sequence
  synthetic oligonucleotide
gacucgaacgacu

SEQ ID NO: 821 - RNA, 13 nt, Artificial Sequence
  synthetic oligonucleotide
accugccagcaac

SEQ ID NO: 822 - RNA, 22 nt, Artificial Sequence
  synthetic oligonucleotide
ugagguaguagguuguauaguu

SEQ ID NO: 823 - RNA, 20 nt, Artificial Sequence
  synthetic oligonucleotide
ugagguaguagguuguauag

SEQ ID NO: 824 - RNA, 14 nt, Artificial Sequence
  synthetic oligonucleotide
aaccuacuaccuca

SEQ ID NO: 825 - RNA, 21 nt, Artificial Sequence
  synthetic oligonucleotide
cuauacaaucuacugucuuuc

SEQ ID NO: 826 - RNA, 20 nt, Artificial Sequence
  synthetic oligonucleotide
cuauacaaucuacugucuuu

SEQ ID NO: 827 - RNA, 14 nt, Artificial Sequence
  synthetic oligonucleotide
aguagauuguauag

SEQ ID NO: 828 - RNA, 22 nt, Artificial Sequence
  synthetic oligonucleotide
cuguacagccuccuagcuuucc

SEQ ID NO: 829 - RNA, 20 nt, Artificial Sequence
  synthetic oligonucleotide
cuguacagccuccuagcuuu

SEQ ID NO: 830 - RNA, 14 nt, Artificial Sequence
  synthetic oligonucleotide
aggaggcuguacag

SEQ ID NO: 831 - RNA, 22 nt, Artificial Sequence
  synthetic oligonucleotide
ugagguaguagguugugugguu

SEQ ID NO: 832 - RNA, 20 nt, Artificial Sequence
  synthetic oligonucleotide
ugagguaguagguugugugg

SEQ ID NO: 833 - RNA, 14 nt, Artificial Sequence
  synthetic oligonucleotide
aaccuacuaccuca

SEQ ID NO: 834 - RNA, 22 nt, Artificial Sequence
  synthetic oligonucleotide
cuauacaaccuacugccuuccc

SEQ ID NO: 835 - RNA, 20 nt, Artificial Sequence
  synthetic oligonucleotide
cuauacaaccuacugccuuc

SEQ ID NO: 836 - RNA, 14 nt, Artificial Sequence
  synthetic oligonucleotide
aguagguuguauag

SEQ ID NO: 837 - RNA, 22 nt, Artificial Sequence
  synthetic oligonucleotide
ugagguaguagguuguaugguu

SEQ ID NO: 838 - RNA, 20 nt, Artificial Sequence
  synthetic oligonucleotide
ugagguaguagguuguaugg

SEQ ID NO: 839 - RNA, 14 nt, Artificial Sequence
  synthetic oligonucleotide
aaccuacuaccuca

SEQ ID NO: 840 - RNA, 22 nt, Artificial Sequence
  synthetic oligonucleotide
uagaguuacacccugggaguua

SEQ ID NO: 841 - RNA, 20 nt, Artificial Sequence
  synthetic oligonucleotide
uagaguuacacccugggagu

SEQ ID NO: 842 - RNA, 14 nt, Artificial Sequence
  synthetic oligonucleotide
aggguguaacucua

SEQ ID NO: 843 - RNA, 22 nt, Artificial Sequence
  synthetic oligonucleotide
agagguaguagguugcauaguu

SEQ ID NO: 844 - RNA, 20 nt, Artificial Sequence
  synthetic oligonucleotide
agagguaguagguugcauag

SEQ ID NO: 845 - RNA, 14 nt, Artificial Sequence
  synthetic oligonucleotide
aaccuacuaccucu

SEQ ID NO: 846 - RNA, 22 nt, Artificial Sequence
  synthetic oligonucleotide
cuauacgaccugcugccuuucu

SEQ ID NO: 847 - RNA, 20 nt, Artificial Sequence
  synthetic oligonucleotide
cuauacgaccugcugccuuu

SEQ ID NO: 848 - RNA, 14 nt, Artificial Sequence
  synthetic oligonucleotide
agcaggucguauag

SEQ ID NO: 849 - RNA, 22 nt, Artificial Sequence
  synthetic oligonucleotide
ugagguaggagguuguauaguu

SEQ ID NO: 850 - RNA, 20 nt, Artificial Sequence
  synthetic oligonucleotide
ugagguaggagguuguauag

SEQ ID NO: 851 - RNA, 14 nt, Artificial Sequence
  synthetic oligonucleotide
aaccuccuaccuca

SEQ ID NO: 852 - RNA, 22 nt, Artificial Sequence
  synthetic oligonucleotide
cuauacggccuccuagcuuucc

SEQ ID NO: 853 - RNA, 20 nt, Artificial Sequence
  synthetic oligonucleotide
cuauacggccuccuagcuuu

SEQ ID NO: 854 - RNA, 14 nt, Artificial Sequence
  synthetic oligonucleotide
aggaggccguauag

SEQ ID NO: 855 - RNA, 22 nt, Artificial Sequence
  synthetic oligonucleotide
ugagguaguagauuguauaguu

SEQ ID NO: 856 - RNA, 20 nt, Artificial Sequence
  synthetic oligonucleotide
ugagguaguagauuguauag

SEQ ID NO: 857 - RNA, 14 nt, Artificial Sequence
  synthetic oligonucleotide
aaucuacuaccuca

SEQ ID NO: 858 - RNA, 22 nt, Artificial Sequence
  synthetic oligonucleotide
cuauacaaucuauugccuuccc

SEQ ID NO: 859 - RNA, 20 nt, Artificial Sequence
  synthetic oligonucleotide
cuauacaaucuauugccuuc

SEQ ID NO: 860 - RNA, 14 nt, Artificial Sequence
  synthetic oligonucleotide
aauagauuguauag

SEQ ID NO: 861 - RNA, 22 nt, Artificial Sequence
  synthetic oligonucleotide
cuauacagucuacugucuuucc

SEQ ID NO: 862 - RNA, 20 nt, Artificial Sequence
  synthetic oligonucleotide
cuauacagucuacugucuuu

SEQ ID NO: 863 - RNA, 14 nt, Artificial Sequence
  synthetic oligonucleotide
aguagacuguauag

SEQ ID NO: 864 - RNA, 22 nt, Artificial Sequence
  synthetic oligonucleotide
ugagguaguaguuuguacaguu

SEQ ID NO: 865 - RNA, 20 nt, Artificial Sequence
  synthetic oligonucleotide
ugagguaguaguuuguacag

SEQ ID NO: 866 - RNA, 14 nt, Artificial Sequence
  synthetic oligonucleotide
aaacuacuaccuca

SEQ ID NO: 867 - RNA, 21 nt, Artificial Sequence
  synthetic oligonucleotide
cuguacaggccacugccuugc

SEQ ID NO: 868 - RNA, 20 nt, Artificial Sequence
  synthetic oligonucleotide
cuguacaggccacugccuug

SEQ ID NO: 869 - RNA, 14 nt, Artificial Sequence
  synthetic oligonucleotide
aguggccuguacag

SEQ ID NO: 870 - RNA, 22 nt, Artificial Sequence
  synthetic oligonucleotide
ugagguaguaguuugugcuguu

SEQ ID NO: 871 - RNA, 20 nt, Artificial Sequence
  synthetic oligonucleotide
ugagguaguaguuugugcug

SEQ ID NO: 872 - RNA, 14 nt, Artificial Sequence
  synthetic oligonucleotide
aaacuacuaccuca

SEQ ID NO: 873 - RNA, 22 nt, Artificial Sequence
  synthetic oligonucleotide
cugcgcaagcuacugccuugcu

SEQ ID NO: 874 - RNA, 20 nt, Artificial Sequence
  synthetic oligonucleotide
cugcgcaagcuacugccuug

SEQ ID NO: 875 - RNA, 14 nt, Artificial Sequence
  synthetic oligonucleotide
aguagcuugcgcag

SEQ ID NO: 876 - RNA, 22 nt, Artificial Sequence
  synthetic oligonucleotide
uggaauguaaagaaguauguau

SEQ ID NO: 877 - RNA, 20 nt, Artificial Sequence
  synthetic oligonucleotide
uggaauguaaagaaguaugu

SEQ ID NO: 878 - RNA, 14 nt, Artificial Sequence
  synthetic oligonucleotide
uucuuuacauucca

SEQ ID NO: 879 - RNA, 22 nt, Artificial Sequence
  synthetic oligonucleotide
aacccguagauccgaacuugug

SEQ ID NO: 880 - RNA, 20 nt, Artificial Sequence
  synthetic oligonucleotide
aacccguagauccgaacuug

SEQ ID NO: 881 - RNA, 14 nt, Artificial Sequence
  synthetic oligonucleotide
cggaucuacggguu

SEQ ID NO: 882 - RNA, 22 nt, Artificial Sequence
  synthetic oligonucleotide
caagcuuguaucuauagguaug

SEQ ID NO: 883 - RNA, 20 nt, Artificial Sequence
  synthetic oligonucleotide
caagcuuguaucuauaggua

SEQ ID NO: 884 - RNA, 14 nt, Artificial Sequence
  synthetic oligonucleotide
uagauacaagcuug

SEQ ID NO: 885 - RNA, 21 nt, Artificial Sequence
  synthetic oligonucleotide
uacaguacugugauaacugaa

SEQ ID NO: 886 - RNA, 20 nt, Artificial Sequence
  synthetic oligonucleotide
uacaguacugugauaacuga

SEQ ID NO: 887 - RNA, 14 nt, Artificial Sequence
  synthetic oligonucleotide
aucacaguacugua

SEQ ID NO: 888 - RNA, 22 nt, Artificial Sequence
  synthetic oligonucleotide
caguuaucacagugcugaugcu

SEQ ID NO: 889 - RNA, 20 nt, Artificial Sequence
  synthetic oligonucleotide
caguuaucacagugcugaug

SEQ ID NO: 890 - RNA, 14 nt, Artificial Sequence
  synthetic oligonucleotide
cacugugauaacug

SEQ ID NO: 891 - RNA, 23 nt, Artificial Sequence
  synthetic oligonucleotide
agcagcauuguacagggcuauga

SEQ ID NO: 892 - RNA, 20 nt, Artificial Sequence
  synthetic oligonucleotide
agcagcauuguacagggcua

SEQ ID NO: 893 - RNA, 14 nt, Artificial Sequence
  synthetic oligonucleotide
uguacaaugcugcu

SEQ ID NO: 894 - RNA, 23 nt, Artificial Sequence
  synthetic oligonucleotide
agcuucuuuacagugcugccuug

SEQ ID NO: 895 - RNA, 20 nt, Artificial Sequence
  synthetic oligonucleotide
agcuucuuuacagugcugcc

SEQ ID NO: 896 - RNA, 14 nt, Artificial Sequence
  synthetic oligonucleotide
acuguaaagaagcu

SEQ ID NO: 897 - RNA, 23 nt, Artificial Sequence
  synthetic oligonucleotide
ucauagcccuguacaaugcugcu

SEQ ID NO: 898 - RNA, 20 nt, Artificial Sequence
  synthetic oligonucleotide
ucauagcccuguacaaugcu

SEQ ID NO: 899 - RNA, 14 nt, Artificial Sequence
  synthetic oligonucleotide
guacagggcuauga

SEQ ID NO: 900 - RNA, 23 nt, Artificial Sequence
  synthetic oligonucleotide
ucaaaugcucagacuccuguggu

SEQ ID NO: 901 - RNA, 20 nt, Artificial Sequence
  synthetic oligonucleotide
ucaaaugcucagacuccugu

SEQ ID NO: 902 - RNA, 14 nt, Artificial Sequence
  synthetic oligonucleotide
gucugagcauuuga

SEQ ID NO: 903 - RNA, 22 nt, Artificial Sequence
  synthetic oligonucleotide
acggauguuugagcaugugcua

SEQ ID NO: 904 - RNA, 20 nt, Artificial Sequence
  synthetic oligonucleotide
acggauguuugagcaugugc

SEQ ID NO: 905 - RNA, 14 nt, Artificial Sequence
  synthetic oligonucleotide
gcucaaacauccgu

SEQ ID NO: 906 - RNA, 23 nt, Artificial Sequence
  synthetic oligonucleotide
aaaagugcuuacagugcagguag

SEQ ID NO: 907 - RNA, 20 nt, Artificial Sequence
  synthetic oligonucleotide
aaaagugcuuacagugcagg

SEQ ID NO: 908 - RNA, 14 nt, Artificial Sequence
  synthetic oligonucleotide
cuguaagcacuuuu

SEQ ID NO: 909 - RNA, 22 nt, Artificial Sequence
  synthetic oligonucleotide
cugcaauguaagcacuucuuac

SEQ ID NO: 910 - RNA, 20 nt, Artificial Sequence
  synthetic oligonucleotide
cugcaauguaagcacuucuu

SEQ ID NO: 911 - RNA, 14 nt, Artificial Sequence
  synthetic oligonucleotide
ugcuuacauugcag

SEQ ID NO: 912 - RNA, 21 nt, Artificial Sequence
  synthetic oligonucleotide
uaaagugcugacagugcagau

SEQ ID NO: 913 - RNA, 20 nt, Artificial Sequence
  synthetic oligonucleotide
uaaagugcugacagugcaga

SEQ ID NO: 914 - RNA, 14 nt, Artificial Sequence
  synthetic oligonucleotide
cugucagcacuuua

SEQ ID NO: 915 - RNA, 22 nt, Artificial Sequence
  synthetic oligonucleotide
ccgcacuguggguacuugcugc

SEQ ID NO: 916 - RNA, 20 nt, Artificial Sequence
  synthetic oligonucleotide
ccgcacuguggguacuugcu

SEQ ID NO: 917 - RNA, 14 nt, Artificial Sequence
  synthetic oligonucleotide
uacccacagugcgg

SEQ ID NO: 918 - RNA, 23 nt, Artificial Sequence
  synthetic oligonucleotide
agcagcauuguacagggcuauca

SEQ ID NO: 919 - RNA, 20 nt, Artificial Sequence
  synthetic oligonucleotide
agcagcauuguacagggcua

SEQ ID NO: 920 - RNA, 14 nt, Artificial Sequence
  synthetic oligonucleotide
uguacaaugcugcu

SEQ ID NO: 921 - RNA, 23 nt, Artificial Sequence
  synthetic oligonucleotide
uacccuguagauccgaauuugug

SEQ ID NO: 922 - RNA, 20 nt, Artificial Sequence
  synthetic oligonucleotide
uacccuguagauccgaauuu

SEQ ID NO: 923 - RNA, 14 nt, Artificial Sequence
  synthetic oligonucleotide
ggaucuacagggua

SEQ ID NO: 924 - RNA, 22 nt, Artificial Sequence
  synthetic oligonucleotide
caaauucguaucuaggggaaua

SEQ ID NO: 925 - RNA, 20 nt, Artificial Sequence
  synthetic oligonucleotide
caaauucguaucuaggggaa

SEQ ID NO: 926 - RNA, 14 nt, Artificial Sequence
  synthetic oligonucleotide
uagauacgaauuug

SEQ ID NO: 927 - RNA, 23 nt, Artificial Sequence
  synthetic oligonucleotide
uacccuguagaaccgaauuugug

SEQ ID NO: 928 - RNA, 20 nt, Artificial Sequence
  synthetic oligonucleotide
uacccuguagaaccgaauuu

SEQ ID NO: 929 - RNA, 14 nt, Artificial Sequence
  synthetic oligonucleotide
gguucuacagggua

SEQ ID NO: 930 - RNA, 22 nt, Artificial Sequence
  synthetic oligonucleotide
acagauucgauucuaggggaau

SEQ ID NO: 931 - RNA, 20 nt, Artificial Sequence
  synthetic oligonucleotide
acagauucgauucuagggga

SEQ ID NO: 932 - RNA, 14 nt, Artificial Sequence
  synthetic oligonucleotide
agaaucgaaucugu

SEQ ID NO: 933 - RNA, 21 nt, Artificial Sequence
  synthetic oligonucleotide
uugcucacuguucuucccuag

SEQ ID NO: 934 - RNA, 20 nt, Artificial Sequence
  synthetic oligonucleotide
uugcucacuguucuucccua

SEQ ID NO: 935 - RNA, 14 nt, Artificial Sequence
  synthetic oligonucleotide
agaacagugagcaa

SEQ ID NO: 936 - RNA, 21 nt, Artificial Sequence
  synthetic oligonucleotide
aagcauucuuucauugguugg

SEQ ID NO: 937 - RNA, 20 nt, Artificial Sequence
  synthetic oligonucleotide
aagcauucuuucauugguug

SEQ ID NO: 938 - RNA, 14 nt, Artificial Sequence
  synthetic oligonucleotide
augaaagaaugcuu

SEQ ID NO: 939 - RNA, 22 nt, Artificial Sequence
  synthetic oligonucleotide
uuuccggcucgcgugggugugu

SEQ ID NO: 940 - RNA, 20 nt, Artificial Sequence
  synthetic oligonucleotide
uuuccggcucgcgugggugu

SEQ ID NO: 941 - RNA, 14 nt, Artificial Sequence
  synthetic oligonucleotide
acgcgagccggaaa

SEQ ID NO: 942 - RNA, 21 nt, Artificial Sequence
  synthetic oligonucleotide
ccgucgccgccacccgagccg

SEQ ID NO: 943 - RNA, 20 nt, Artificial Sequence
  synthetic oligonucleotide
ccgucgccgccacccgagcc

SEQ ID NO: 944 - RNA, 14 nt, Artificial Sequence
  synthetic oligonucleotide
gguggcggcgacgg

SEQ ID NO: 945 - RNA, 23 nt, Artificial Sequence
  synthetic oligonucleotide
gagggucuugggagggaugugac

SEQ ID NO: 946 - RNA, 20 nt, Artificial Sequence
  synthetic oligonucleotide
gagggucuugggagggaugu

SEQ ID NO: 947 - RNA, 14 nt, Artificial Sequence
  synthetic oligonucleotide
cucccaagacccuc

SEQ ID NO: 948 - RNA, 27 nt, Artificial Sequence
  synthetic oligonucleotide
cacuguaggugauggugagagugggca

SEQ ID NO: 949 - RNA, 20 nt, Artificial Sequence
  synthetic oligonucleotide
cacuguaggugauggugaga

SEQ ID NO: 950 - RNA, 14 nt, Artificial Sequence
  synthetic oligonucleotide
caucaccuacagug

SEQ ID NO: 951 - RNA, 23 nt, Artificial Sequence
  synthetic oligonucleotide
ccugcagcgacuugauggcuucc

SEQ ID NO: 952 - RNA, 20 nt, Artificial Sequence
  synthetic oligonucleotide
ccugcagcgacuugauggcu

SEQ ID NO: 953 - RNA, 14 nt, Artificial Sequence
  synthetic oligonucleotide
caagucgcugcagg

SEQ ID NO: 954 - RNA, 21 nt, Artificial Sequence
  synthetic oligonucleotide
agaggauacccuuuguauguu

SEQ ID NO: 955 - RNA, 20 nt, Artificial Sequence
  synthetic oligonucleotide
agaggauacccuuuguaugu

SEQ ID NO: 956 - RNA, 14 nt, Artificial Sequence
  synthetic oligonucleotide
aaaggguauccucu

SEQ ID NO: 957 - RNA, 23 nt, Artificial Sequence
  synthetic oligonucleotide
gggaugguagaccggugacgugc

SEQ ID NO: 958 - RNA, 20 nt, Artificial Sequence
  synthetic oligonucleotide
gggaugguagaccggugacg

SEQ ID NO: 959 - RNA, 14 nt, Artificial Sequence
  synthetic oligonucleotide
cggucuaccauccc

SEQ ID NO: 960 - RNA, 21 nt, Artificial Sequence
  synthetic oligonucleotide
uaggacacauggucuacuucu

SEQ ID NO: 961 - RNA, 20 nt, Artificial Sequence
  synthetic oligonucleotide
uaggacacauggucuacuuc

SEQ ID NO: 962 - RNA, 14 nt, Artificial Sequence
  synthetic oligonucleotide
gaccauguguccua

SEQ ID NO: 963 - RNA, 22 nt, Artificial Sequence
  synthetic oligonucleotide
cuccugagccauucugagccuc

SEQ ID NO: 964 - RNA, 20 nt, Artificial Sequence
  synthetic oligonucleotide
cuccugagccauucugagcc

SEQ ID NO: 965 - RNA, 14 nt, Artificial Sequence
  synthetic oligonucleotide
gaauggcucaggag

SEQ ID NO: 966 - RNA, 21 nt, Artificial Sequence
  synthetic oligonucleotide
gugccagcugcagugggggag

SEQ ID NO: 967 - RNA, 20 nt, Artificial Sequence
  synthetic oligonucleotide
gugccagcugcaguggggga

SEQ ID NO: 968 - RNA, 14 nt, Artificial Sequence
  synthetic oligonucleotide
acugcagcuggcac

SEQ ID NO: 969 - RNA, 21 nt, Artificial Sequence
  synthetic oligonucleotide
cccggagccaggaugcagcuc

SEQ ID NO: 970 - RNA, 20 nt, Artificial Sequence
  synthetic oligonucleotide
cccggagccaggaugcagcu

SEQ ID NO: 971 - RNA, 14 nt, Artificial Sequence
  synthetic oligonucleotide
auccuggcuccggg

SEQ ID NO: 972 - RNA, 21 nt, Artificial Sequence
  synthetic oligonucleotide
ucguggccuggucuccauuau

SEQ ID NO: 973 - RNA, 20 nt, Artificial Sequence
  synthetic oligonucleotide
ucguggccuggucuccauua

SEQ ID NO: 974 - RNA, 14 nt, Artificial Sequence
  synthetic oligonucleotide
agaccaggccacga

SEQ ID NO: 975 - RNA, 20 nt, Artificial Sequence
  synthetic oligonucleotide
ucugcaggguuugcuuugag

SEQ ID NO: 976 - RNA, 20 nt, Artificial Sequence
  synthetic oligonucleotide
ucugcaggguuugcuuugag

SEQ ID NO: 977 - RNA, 14 nt, Artificial Sequence
  synthetic oligonucleotide
gcaaacccugcaga

SEQ ID NO: 978 - RNA, 21 nt, Artificial Sequence
  synthetic oligonucleotide
uguucauguagauguuuaagc

SEQ ID NO: 979 - RNA, 20 nt, Artificial Sequence
  synthetic oligonucleotide
uguucauguagauguuuaag

SEQ ID NO: 980 - RNA, 14 nt, Artificial Sequence
  synthetic oligonucleotide
caucuacaugaaca

SEQ ID NO: 981 - RNA, 18 nt, Artificial Sequence
  synthetic oligonucleotide
ucagcuggcccucauuuc

SEQ ID NO: 982 - RNA, 18 nt, Artificial Sequence
  synthetic oligonucleotide
ucagcuggcccucauuuc

SEQ ID NO: 983 - RNA, 14 nt, Artificial Sequence
  synthetic oligonucleotide
ugagggccagcuga

SEQ ID NO: 984 - RNA, 21 nt, Artificial Sequence
  synthetic oligonucleotide
uggcagggaggcugggagggg

SEQ ID NO: 985 - RNA, 20 nt, Artificial Sequence
  synthetic oligonucleotide
uggcagggaggcugggaggg

SEQ ID NO: 986 - RNA, 14 nt, Artificial Sequence
  synthetic oligonucleotide
cagccucccugcca

SEQ ID NO: 987 - RNA, 20 nt, Artificial Sequence
  synthetic oligonucleotide
ucacuguucagacaggcgga

SEQ ID NO: 988 - RNA, 20 nt, Artificial Sequence
  synthetic oligonucleotide
ucacuguucagacaggcgga

SEQ ID NO: 989 - RNA, 14 nt, Artificial Sequence
  synthetic oligonucleotide
ugucugaacaguga

SEQ ID NO: 990 - RNA, 22 nt, Artificial Sequence
  synthetic oligonucleotide
uggagugugacaaugguguuug

SEQ ID NO: 991 - RNA, 20 nt, Artificial Sequence
  synthetic oligonucleotide
uggagugugacaaugguguu

SEQ ID NO: 992 - RNA, 14 nt, Artificial Sequence
  synthetic oligonucleotide
auugucacacucca

SEQ ID NO: 993 - RNA, 22 nt, Artificial Sequence
  synthetic oligonucleotide
aacgccauuaucacacuaaaua

SEQ ID NO: 994 - RNA, 20 nt, Artificial Sequence
  synthetic oligonucleotide
aacgccauuaucacacuaaa

SEQ ID NO: 995 - RNA, 14 nt, Artificial Sequence
  synthetic oligonucleotide
gugauaauggcguu

SEQ ID NO: 996 - RNA, 21 nt, Artificial Sequence
  synthetic oligonucleotide
ccccaccuccucucuccucag

SEQ ID NO: 997 - RNA, 20 nt, Artificial Sequence
  synthetic oligonucleotide
ccccaccuccucucuccuca

SEQ ID NO: 998 - RNA, 14 nt, Artificial Sequence
  synthetic oligonucleotide
gagaggaggugggg

SEQ ID NO: 999 - RNA, 19 nt, Artificial Sequence
  synthetic oligonucleotide
gugaggacucgggaggugg

SEQ ID NO: 1000 - RNA, 19 nt, Artificial Sequence
  synthetic oligonucleotide
gugaggacucgggaggugg

SEQ ID NO: 1001 - RNA, 14 nt, Artificial Sequence
  synthetic oligonucleotide
ucccgaguccucac

SEQ ID NO: 1002 - RNA, 22 nt, Artificial Sequence
  synthetic oligonucleotide
ugagccccugugccgcccccag

SEQ ID NO: 1003 - RNA, 20 nt, Artificial Sequence
  synthetic oligonucleotide
ugagccccugugccgccccc

SEQ ID NO: 1004 - RNA, 14 nt, Artificial Sequence
  synthetic oligonucleotide
ggcacaggggcuca

SEQ ID NO: 1005 - RNA, 22 nt, Artificial Sequence
  synthetic oligonucleotide
guggguacggcccagugggggg

SEQ ID NO: 1006 - RNA, 20 nt, Artificial Sequence
  synthetic oligonucleotide
guggguacggcccagugggg

SEQ ID NO: 1007 - RNA, 14 nt, Artificial Sequence
  synthetic oligonucleotide
ugggccguacccac

SEQ ID NO: 1008 - RNA, 22 nt, Artificial Sequence
  synthetic oligonucleotide
ucaccagcccuguguucccuag

SEQ ID NO: 1009 - RNA, 20 nt, Artificial Sequence
  synthetic oligonucleotide
ucaccagcccuguguucccu

SEQ ID NO: 1010 - RNA, 14 nt, Artificial Sequence
  synthetic oligonucleotide
cacagggcugguga

SEQ ID NO: 1011 - RNA, 26 nt, Artificial Sequence
  synthetic oligonucleotide
gugagggcaugcaggccuggaugggg

SEQ ID NO: 1012 - RNA, 20 nt, Artificial Sequence
  synthetic oligonucleotide
gugagggcaugcaggccugg

SEQ ID NO: 1013 - RNA, 14 nt, Artificial Sequence
  synthetic oligonucleotide
cugcaugcccucac

SEQ ID NO: 1014 - RNA, 20 nt, Artificial Sequence
  synthetic oligonucleotide
cgugccacccuuuuccccag

SEQ ID NO: 1015 - RNA, 20 nt, Artificial Sequence
  synthetic oligonucleotide
cgugccacccuuuuccccag

SEQ ID NO: 1016 - RNA, 14 nt, Artificial Sequence
  synthetic oligonucleotide
aaaaggguggcacg

SEQ ID NO: 1017 - RNA, 20 nt, Artificial Sequence
  synthetic oligonucleotide
ucacaccugccucgcccccc

SEQ ID NO: 1018 - RNA, 20 nt, Artificial Sequence
  synthetic oligonucleotide
ucacaccugccucgcccccc

SEQ ID NO: 1019 - RNA, 14 nt, Artificial Sequence
  synthetic oligonucleotide
cgaggcagguguga

SEQ ID NO: 1020 - RNA, 21 nt, Artificial Sequence
  synthetic oligonucleotide
gugggcgggggcaggugugug

SEQ ID NO: 1021 - RNA, 20 nt, Artificial Sequence
  synthetic oligonucleotide
gugggcgggggcaggugugu

SEQ ID NO: 1022 - RNA, 14 nt, Artificial Sequence
  synthetic oligonucleotide
cugcccccgcccac

SEQ ID NO: 1023 - RNA, 23 nt, Artificial Sequence
  synthetic oligonucleotide
cucucaccacugcccucccacag

SEQ ID NO: 1024 - RNA, 20 nt, Artificial Sequence
  synthetic oligonucleotide
cucucaccacugcccuccca

SEQ ID NO: 1025 - RNA, 14 nt, Artificial Sequence
  synthetic oligonucleotide
ggcaguggugagag

SEQ ID NO: 1026 - RNA, 20 nt, Artificial Sequence
  synthetic oligonucleotide
gugucugggcggacagcugc

SEQ ID NO: 1027 - RNA, 20 nt, Artificial Sequence
  synthetic oligonucleotide
gugucugggcggacagcugc

SEQ ID NO: 1028 - RNA, 14 nt, Artificial Sequence
  synthetic oligonucleotide
guccgcccagacac

SEQ ID NO: 1029 - RNA, 20 nt, Artificial Sequence
  synthetic oligonucleotide
ugagcccuguccucccgcag

SEQ ID NO: 1030 - RNA, 20 nt, Artificial Sequence
  synthetic oligonucleotide
ugagcccuguccucccgcag

SEQ ID NO: 1031 - RNA, 14 nt, Artificial Sequence
  synthetic oligonucleotide
gaggacagggcuca

SEQ ID NO: 1032 - RNA, 22 nt, Artificial Sequence
  synthetic oligonucleotide
ucggccugaccacccaccccac

SEQ ID NO: 1033 - RNA, 20 nt, Artificial Sequence
  synthetic oligonucleotide
ucggccugaccacccacccc

SEQ ID NO: 1034 - RNA, 14 nt, Artificial Sequence
  synthetic oligonucleotide
gguggucaggccga

SEQ ID NO: 1035 - RNA, 22 nt, Artificial Sequence
  synthetic oligonucleotide
ccucuuccccuugucucuccag

SEQ ID NO: 1036 - RNA, 20 nt, Artificial Sequence
  synthetic oligonucleotide
ccucuuccccuugucucucc

SEQ ID NO: 1037 - RNA, 14 nt, Artificial Sequence
  synthetic oligonucleotide
acaaggggaagagg

SEQ ID NO: 1038 - RNA, 21 nt, Artificial Sequence
  synthetic oligonucleotide
uccuucugcuccgucccccag

SEQ ID NO: 1039 - RNA, 20 nt, Artificial Sequence
  synthetic oligonucleotide
uccuucugcuccguccccca

SEQ ID NO: 1040 - RNA, 14 nt, Artificial Sequence
  synthetic oligonucleotide
acggagcagaagga

SEQ ID NO: 1041 - RNA, 20 nt, Artificial Sequence
  synthetic oligonucleotide
cuuccucgucugucugcccc

SEQ ID NO: 1042 - RNA, 20 nt, Artificial Sequence
  synthetic oligonucleotide
cuuccucgucugucugcccc

SEQ ID NO: 1043 - RNA, 14 nt, Artificial Sequence
  synthetic oligonucleotide
gacagacgaggaag

SEQ ID NO: 1044 - RNA, 20 nt, Artificial Sequence
  synthetic oligonucleotide
uaaggcacgcggugaaugcc

SEQ ID NO: 1045 - RNA, 20 nt, Artificial Sequence
  synthetic oligonucleotide
uaaggcacgcggugaaugcc

SEQ ID NO: 1046 - RNA, 14 nt, Artificial Sequence
  synthetic oligonucleotide
caccgcgugccuua

SEQ ID NO: 1047 - RNA, 22 nt, Artificial Sequence
  synthetic oligonucleotide
cguguucacagcggaccuugau

SEQ ID NO: 1048 - RNA, 20 nt, Artificial Sequence
  synthetic oligonucleotide
cguguucacagcggaccuug

SEQ ID NO: 1049 - RNA, 14 nt, Artificial Sequence
  synthetic oligonucleotide
ccgcugugaacacg

SEQ ID NO: 1050 - RNA, 22 nt, Artificial Sequence
  synthetic oligonucleotide
aacuggaucaauuauaggagug

SEQ ID NO: 1051 - RNA, 20 nt, Artificial Sequence
  synthetic oligonucleotide
aacuggaucaauuauaggag

SEQ ID NO: 1052 - RNA, 14 nt, Artificial Sequence
  synthetic oligonucleotide
uaauugauccaguu

SEQ ID NO: 1053 - RNA, 26 nt, Artificial Sequence
  synthetic oligonucleotide
aaguaguugguuuguaugagaugguu

SEQ ID NO: 1054 - RNA, 20 nt, Artificial Sequence
  synthetic oligonucleotide
aaguaguugguuuguaugag

SEQ ID NO: 1055 - RNA, 14 nt, Artificial Sequence
  synthetic oligonucleotide
caaaccaacuacuu

SEQ ID NO: 1056 - RNA, 21 nt, Artificial Sequence
  synthetic oligonucleotide
aagugaucuaaaggccuacau

SEQ ID NO: 1057 - RNA, 20 nt, Artificial Sequence
  synthetic oligonucleotide
aagugaucuaaaggccuaca

SEQ ID NO: 1058 - RNA, 14 nt, Artificial Sequence
  synthetic oligonucleotide
ccuuuagaucacuu

SEQ ID NO: 1059 - RNA, 19 nt, Artificial Sequence
  synthetic oligonucleotide
aauggauuuuuggagcagg

SEQ ID NO: 1060 - RNA, 19 nt, Artificial Sequence
  synthetic oligonucleotide
aauggauuuuuggagcagg

SEQ ID NO: 1061 - RNA, 14 nt, Artificial Sequence
  synthetic oligonucleotide
uccaaaaauccauu

SEQ ID NO: 1062 - RNA, 22 nt, Artificial Sequence
  synthetic oligonucleotide
acccgucccguucguccccgga

SEQ ID NO: 1063 - RNA, 20 nt, Artificial Sequence
  synthetic oligonucleotide
acccgucccguucguccccg

SEQ ID NO: 1064 - RNA, 14 nt, Artificial Sequence
  synthetic oligonucleotide
cgaacgggacgggu

SEQ ID NO: 1065 - RNA, 27 nt, Artificial Sequence
  synthetic oligonucleotide
accuucuuguauaagcacugugcuaaa

SEQ ID NO: 1066 - RNA, 20 nt, Artificial Sequence
  synthetic oligonucleotide
accuucuuguauaagcacug

SEQ ID NO: 1067 - RNA, 14 nt, Artificial Sequence
  synthetic oligonucleotide
uuauacaagaaggu

SEQ ID NO: 1068 - RNA, 22 nt, Artificial Sequence
  synthetic oligonucleotide
acgcccuucccccccuucuuca

SEQ ID NO: 1069 - RNA, 20 nt, Artificial Sequence
  synthetic oligonucleotide
acgcccuucccccccuucuu

SEQ ID NO: 1070 - RNA, 14 nt, Artificial Sequence
  synthetic oligonucleotide
ggggggaagggcgu

SEQ ID NO: 1071 - RNA, 21 nt, Artificial Sequence
  synthetic oligonucleotide
acggugcuggauguggccuuu

SEQ ID NO: 1072 - RNA, 20 nt, Artificial Sequence
  synthetic oligonucleotide
acggugcuggauguggccuu

SEQ ID NO: 1073 - RNA, 14 nt, Artificial Sequence
  synthetic oligonucleotide
acauccagcaccgu

SEQ ID NO: 1074 - RNA, 21 nt, Artificial Sequence
  synthetic oligonucleotide
acucuagcugccaaaggcgcu

SEQ ID NO: 1075 - RNA, 20 nt, Artificial Sequence
  synthetic oligonucleotide
acucuagcugccaaaggcgc

SEQ ID NO: 1076 - RNA, 14 nt, Artificial Sequence
  synthetic oligonucleotide
uuggcagcuagagu

SEQ ID NO: 1077 - RNA, 22 nt, Artificial Sequence
  synthetic oligonucleotide
agaaggaaauugaauucauuua

SEQ ID NO: 1078 - RNA, 20 nt, Artificial Sequence
  synthetic oligonucleotide
agaaggaaauugaauucauu

SEQ ID NO: 1079 - RNA, 14 nt, Artificial Sequence
  synthetic oligonucleotide
uucaauuuccuucu

SEQ ID NO: 1080 - RNA, 21 nt, Artificial Sequence
  synthetic oligonucleotide
agagaagaagaucagccugca

SEQ ID NO: 1081 - RNA, 20 nt, Artificial Sequence
  synthetic oligonucleotide
agagaagaagaucagccugc

SEQ ID NO: 1082 - RNA, 14 nt, Artificial Sequence
  synthetic oligonucleotide
ugaucuucuucucu

SEQ ID NO: 1083 - RNA, 24 nt, Artificial Sequence
  synthetic oligonucleotide
agccuggaagcuggagccugcagu

SEQ ID NO: 1084 - RNA, 20 nt, Artificial Sequence
  synthetic oligonucleotide
agccuggaagcuggagccug

SEQ ID NO: 1085 - RNA, 14 nt, Artificial Sequence
  synthetic oligonucleotide
ccagcuuccaggcu

SEQ ID NO: 1086 - RNA, 23 nt, Artificial Sequence
  synthetic oligonucleotide
aggaugagcaaagaaaguagauu

SEQ ID NO: 1087 - RNA, 20 nt, Artificial Sequence
  synthetic oligonucleotide
aggaugagcaaagaaaguag

SEQ ID NO: 1088 - RNA, 14 nt, Artificial Sequence
  synthetic oligonucleotide
ucuuugcucauccu

SEQ ID NO: 1089 - RNA, 22 nt, Artificial Sequence
  synthetic oligonucleotide
cggaugagcaaagaaagugguu

SEQ ID NO: 1090 - RNA, 20 nt, Artificial Sequence
  synthetic oligonucleotide
cggaugagcaaagaaagugg

SEQ ID NO: 1091 - RNA, 14 nt, Artificial Sequence
  synthetic oligonucleotide
ucuuugcucauccg

SEQ ID NO: 1092 - RNA, 22 nt, Artificial Sequence
  synthetic oligonucleotide
aggcauugacuucucacuagcu

SEQ ID NO: 1093 - RNA, 20 nt, Artificial Sequence
  synthetic oligonucleotide
aggcauugacuucucacuag

SEQ ID NO: 1094 - RNA, 14 nt, Artificial Sequence
  synthetic oligonucleotide
agaagucaaugccu

SEQ ID NO: 1095 - RNA, 21 nt, Artificial Sequence
  synthetic oligonucleotide
agugaaugauggguucugacc

SEQ ID NO: 1096 - RNA, 20 nt, Artificial Sequence
  synthetic oligonucleotide
agugaaugauggguucugac

SEQ ID NO: 1097 - RNA, 14 nt, Artificial Sequence
  synthetic oligonucleotide
acccaucauucacu

SEQ ID NO: 1098 - RNA, 21 nt, Artificial Sequence
  synthetic oligonucleotide
aguuaggauuaggucguggaa

SEQ ID NO: 1099 - RNA, 20 nt, Artificial Sequence
  synthetic oligonucleotide
aguuaggauuaggucgugga

SEQ ID NO: 1100 - RNA, 14 nt, Artificial Sequence
  synthetic oligonucleotide
accuaauccuaacu

SEQ ID NO: 1101 - RNA, 22 nt, Artificial Sequence
  synthetic oligonucleotide
acaggugagguucuugggagcc

SEQ ID NO: 1102 - RNA, 20 nt, Artificial Sequence
  synthetic oligonucleotide
acaggugagguucuugggag

SEQ ID NO: 1103 - RNA, 14 nt, Artificial Sequence
  synthetic oligonucleotide
agaaccucaccugu

SEQ ID NO: 1104 - RNA, 24 nt, Artificial Sequence
  synthetic oligonucleotide
ucccugagacccuuuaaccuguga

SEQ ID NO: 1105 - RNA, 20 nt, Artificial Sequence
  synthetic oligonucleotide
ucccugagacccuuuaaccu

SEQ ID NO: 1106 - RNA, 14 nt, Artificial Sequence
  synthetic oligonucleotide
aagggucucaggga

SEQ ID NO: 1107 - RNA, 22 nt, Artificial Sequence
  synthetic oligonucleotide
ucccugagacccuaacuuguga

SEQ ID NO: 1108 - RNA, 20 nt, Artificial Sequence
  synthetic oligonucleotide
ucccugagacccuaacuugu

SEQ ID NO: 1109 - RNA, 14 nt, Artificial Sequence
  synthetic oligonucleotide
uagggucucaggga

SEQ ID NO: 1110 - RNA, 22 nt, Artificial Sequence
  synthetic oligonucleotide
acggguuaggcucuugggagcu

SEQ ID NO: 1111 - RNA, 20 nt, Artificial Sequence
  synthetic oligonucleotide
acggguuaggcucuugggag

SEQ ID NO: 1112 - RNA, 14 nt, Artificial Sequence
  synthetic oligonucleotide
agagccuaacccgu

SEQ ID NO: 1113 - RNA, 22 nt, Artificial Sequence
  synthetic oligonucleotide
ucacaagucaggcucuugggac

SEQ ID NO: 1114 - RNA, 20 nt, Artificial Sequence
  synthetic oligonucleotide
ucacaagucaggcucuuggg

SEQ ID NO: 1115 - RNA, 14 nt, Artificial Sequence
  synthetic oligonucleotide
agccugacuuguga

SEQ ID NO: 1116 - RNA, 22 nt, Artificial Sequence
  synthetic oligonucleotide
ucguaccgugaguaauaaugcg

SEQ ID NO: 1117 - RNA, 20 nt, Artificial Sequence
  synthetic oligonucleotide
ucguaccgugaguaauaaug

SEQ ID NO: 1118 - RNA, 14 nt, Artificial Sequence
  synthetic oligonucleotide
uacucacgguacga

SEQ ID NO: 1119 - RNA, 21 nt, Artificial Sequence
  synthetic oligonucleotide
cauuauuacuuuugguacgcg

SEQ ID NO: 1120 - RNA, 20 nt, Artificial Sequence
  synthetic oligonucleotide
cauuauuacuuuugguacgc

SEQ ID NO: 1121 - RNA, 14 nt, Artificial Sequence
  synthetic oligonucleotide
caaaaguaauaaug

SEQ ID NO: 1122 - RNA, 18 nt, Artificial Sequence
  synthetic oligonucleotide
aucccaccucugccacca

SEQ ID NO: 1123 - RNA, 18 nt, Artificial Sequence
  synthetic oligonucleotide
aucccaccucugccacca

SEQ ID NO: 1124 - RNA, 14 nt, Artificial Sequence
  synthetic oligonucleotide
ggcagaggugggau

SEQ ID NO: 1125 - RNA, 19 nt, Artificial Sequence
  synthetic oligonucleotide
aucccaccacugccaccau

SEQ ID NO: 1126 - RNA, 19 nt, Artificial Sequence
  synthetic oligonucleotide
aucccaccacugccaccau

SEQ ID NO: 1127 - RNA, 14 nt, Artificial Sequence
  synthetic oligonucleotide
ggcaguggugggau

SEQ ID NO: 1128 - RNA, 19 nt, Artificial Sequence
  synthetic oligonucleotide
auggauaaggcuuuggcuu

SEQ ID NO: 1129 - RNA, 19 nt, Artificial Sequence
  synthetic oligonucleotide
auggauaaggcuuuggcuu

SEQ ID NO: 1130 - RNA, 14 nt, Artificial Sequence
  synthetic oligonucleotide
aaagccuuauccau

SEQ ID NO: 1131 - RNA, 22 nt, Artificial Sequence
  synthetic oligonucleotide
augggugaauuuguagaaggau

SEQ ID NO: 1132 - RNA, 20 nt, Artificial Sequence
  synthetic oligonucleotide
augggugaauuuguagaagg

SEQ ID NO: 1133 - RNA, 14 nt, Artificial Sequence
  synthetic oligonucleotide
acaaauucacccau

SEQ ID NO: 1134 - RNA, 22 nt, Artificial Sequence
  synthetic oligonucleotide
augguacccuggcauacugagu

SEQ ID NO: 1135 - RNA, 20 nt, Artificial Sequence
  synthetic oligonucleotide
augguacccuggcauacuga

SEQ ID NO: 1136 - RNA, 14 nt, Artificial Sequence
  synthetic oligonucleotide
ugccaggguaccau

SEQ ID NO: 1137 - RNA, 23 nt, Artificial Sequence
  synthetic oligonucleotide
caagucuuauuugagcaccuguu

SEQ ID NO: 1138 - RNA, 20 nt, Artificial Sequence
  synthetic oligonucleotide
caagucuuauuugagcaccu

SEQ ID NO: 1139 - RNA, 14 nt, Artificial Sequence
  synthetic oligonucleotide
ucaaauaagacuug

SEQ ID NO: 1140 - RNA, 22 nt, Artificial Sequence
  synthetic oligonucleotide
caggauguggucaaguguuguu

SEQ ID NO: 1141 - RNA, 20 nt, Artificial Sequence
  synthetic oligonucleotide
caggauguggucaaguguug

SEQ ID NO: 1142 - RNA, 14 nt, Artificial Sequence
  synthetic oligonucleotide
uugaccacauccug

SEQ ID NO: 1143 - RNA, 23 nt, Artificial Sequence
  synthetic oligonucleotide
ccucagggcuguagaacagggcu

SEQ ID NO: 1144 - RNA, 20 nt, Artificial Sequence
  synthetic oligonucleotide
ccucagggcuguagaacagg

SEQ ID NO: 1145 - RNA, 14 nt, Artificial Sequence
  synthetic oligonucleotide
cuacagcccugagg

SEQ ID NO: 1146 - RNA, 21 nt, Artificial Sequence
  synthetic oligonucleotide
ccuguugaaguguaaucccca

SEQ ID NO: 1147 - RNA, 20 nt, Artificial Sequence
  synthetic oligonucleotide
ccuguugaaguguaaucccc

SEQ ID NO: 1148 - RNA, 14 nt, Artificial Sequence
  synthetic oligonucleotide
uacacuucaacagg

SEQ ID NO: 1149 - RNA, 18 nt, Artificial Sequence
  synthetic oligonucleotide
cgggcguggugguggggg

SEQ ID NO: 1150 - RNA, 18 nt, Artificial Sequence
  synthetic oligonucleotide
cgggcguggugguggggg

SEQ ID NO: 1151 - RNA, 14 nt, Artificial Sequence
  synthetic oligonucleotide
caccaccacgcccg

SEQ ID NO: 1152 - RNA, 22 nt, Artificial Sequence
  synthetic oligonucleotide
cuggacugagccgugcuacugg

SEQ ID NO: 1153 - RNA, 20 nt, Artificial Sequence
  synthetic oligonucleotide
cuggacugagccgugcuacu

SEQ ID NO: 1154 - RNA, 14 nt, Artificial Sequence
  synthetic oligonucleotide
acggcucaguccag

SEQ ID NO: 1155 - RNA, 23 nt, Artificial Sequence
  synthetic oligonucleotide
cuggagauauggaagagcugugu

SEQ ID NO: 1156 - RNA, 20 nt, Artificial Sequence
  synthetic oligonucleotide
cuggagauauggaagagcug

SEQ ID NO: 1157 - RNA, 14 nt, Artificial Sequence
  synthetic oligonucleotide
uuccauaucuccag

SEQ ID NO: 1158 - RNA, 22 nt, Artificial Sequence
  synthetic oligonucleotide
cuuggcaccuagcaagcacuca

SEQ ID NO: 1159 - RNA, 20 nt, Artificial Sequence
  synthetic oligonucleotide
cuuggcaccuagcaagcacu

SEQ ID NO: 1160 - RNA, 14 nt, Artificial Sequence
  synthetic oligonucleotide
ugcuaggugccaag

SEQ ID NO: 1161 - RNA, 26 nt, Artificial Sequence
  synthetic oligonucleotide
gaugaugauggcagcaaauucugaaa

SEQ ID NO: 1162 - RNA, 20 nt, Artificial Sequence
  synthetic oligonucleotide
gaugaugauggcagcaaauu

SEQ ID NO: 1163 - RNA, 14 nt, Artificial Sequence
  synthetic oligonucleotide
cugccaucaucauc

SEQ ID NO: 1164 - RNA, 25 nt, Artificial Sequence
  synthetic oligonucleotide
gggcgacaaagcaagacucuuucuu

SEQ ID NO: 1165 - RNA, 20 nt, Artificial Sequence
  synthetic oligonucleotide
gggcgacaaagcaagacucu

SEQ ID NO: 1166 - RNA, 14 nt, Artificial Sequence
  synthetic oligonucleotide
uugcuuugucgccc

SEQ ID NO: 1167 - RNA, 22 nt, Artificial Sequence
  synthetic oligonucleotide
ggcgacaaaacgagacccuguc

SEQ ID NO: 1168 - RNA, 20 nt, Artificial Sequence
  synthetic oligonucleotide
ggcgacaaaacgagacccug

SEQ ID NO: 1169 - RNA, 14 nt, Artificial Sequence
  synthetic oligonucleotide
cucguuuugucgcc

SEQ ID NO: 1170 - RNA, 25 nt, Artificial Sequence
  synthetic oligonucleotide
gaacccaugagguugaggcugcagu

SEQ ID NO: 1171 - RNA, 20 nt, Artificial Sequence
  synthetic oligonucleotide
gaacccaugagguugaggcu

SEQ ID NO: 1172 - RNA, 14 nt, Artificial Sequence
  synthetic oligonucleotide
aaccucauggguuc

SEQ ID NO: 1173 - RNA, 22 nt, Artificial Sequence
  synthetic oligonucleotide
uugcuugaacccaggaagugga

SEQ ID NO: 1174 - RNA, 20 nt, Artificial Sequence
  synthetic oligonucleotide
uugcuugaacccaggaagug

SEQ ID NO: 1175 - RNA, 14 nt, Artificial Sequence
  synthetic oligonucleotide
cuggguucaagcaa

SEQ ID NO: 1176 - RNA, 22 nt, Artificial Sequence
  synthetic oligonucleotide
ucggauccgucugagcuuggcu

SEQ ID NO: 1177 - RNA, 20 nt, Artificial Sequence
  synthetic oligonucleotide
ucggauccgucugagcuugg

SEQ ID NO: 1178 - RNA, 14 nt, Artificial Sequence
  synthetic oligonucleotide
ucagacggauccga

SEQ ID NO: 1179 - RNA, 18 nt, Artificial Sequence
  synthetic oligonucleotide
gucccuguucaggcgcca

SEQ ID NO: 1180 - RNA, 18 nt, Artificial Sequence
  synthetic oligonucleotide
gucccuguucaggcgcca

SEQ ID NO: 1181 - RNA, 14 nt, Artificial Sequence
  synthetic oligonucleotide
gccugaacagggac

SEQ ID NO: 1182 - RNA, 17 nt, Artificial Sequence
  synthetic oligonucleotide
ucccuguucgggcgcca

SEQ ID NO: 1183 - RNA, 17 nt, Artificial Sequence
  synthetic oligonucleotide
ucccuguucgggcgcca

SEQ ID NO: 1184 - RNA, 14 nt, Artificial Sequence
  synthetic oligonucleotide
cgcccgaacaggga

SEQ ID NO: 1185 - RNA, 17 nt, Artificial Sequence
  synthetic oligonucleotide
gugggggagaggcuguc

SEQ ID NO: 1186 - RNA, 17 nt, Artificial Sequence
  synthetic oligonucleotide
gugggggagaggcuguc

SEQ ID NO: 1187 - RNA, 14 nt, Artificial Sequence
  synthetic oligonucleotide
agccucucccccac

SEQ ID NO: 1188 - RNA, 22 nt, Artificial Sequence
  synthetic oligonucleotide
cugaagcucagagggcucugau

SEQ ID NO: 1189 - RNA, 20 nt, Artificial Sequence
  synthetic oligonucleotide
cugaagcucagagggcucug

SEQ ID NO: 1190 - RNA, 14 nt, Artificial Sequence
  synthetic oligonucleotide
ccucugagcuucag

SEQ ID NO: 1191 - RNA, 20 nt, Artificial Sequence
  synthetic oligonucleotide
uaaagagcccuguggagaca

SEQ ID NO: 1192 - RNA, 20 nt, Artificial Sequence
  synthetic oligonucleotide
uaaagagcccuguggagaca

SEQ ID NO: 1193 - RNA, 14 nt, Artificial Sequence
  synthetic oligonucleotide
cacagggcucuuua

SEQ ID NO: 1194 - RNA, 22 nt, Artificial Sequence
  synthetic oligonucleotide
uacguagauauauauguauuuu

SEQ ID NO: 1195 - RNA, 20 nt, Artificial Sequence
  synthetic oligonucleotide
uacguagauauauauguauu

SEQ ID NO: 1196 - RNA, 14 nt, Artificial Sequence
  synthetic oligonucleotide
uauauaucuacgua

SEQ ID NO: 1197 - RNA, 22 nt, Artificial Sequence
  synthetic oligonucleotide
uaguacugugcauaucaucuau

SEQ ID NO: 1198 - RNA, 20 nt, Artificial Sequence
  synthetic oligonucleotide
uaguacugugcauaucaucu

SEQ ID NO: 1199 - RNA, 14 nt, Artificial Sequence
  synthetic oligonucleotide
uaugcacaguacua

SEQ ID NO: 1200 - RNA, 17 nt, Artificial Sequence
  synthetic oligonucleotide
ucauauugcuucuuucu

SEQ ID NO: 1201 - RNA, 17 nt, Artificial Sequence
  synthetic oligonucleotide
ucauauugcuucuuucu

SEQ ID NO: 1202 - RNA, 14 nt, Artificial Sequence
  synthetic oligonucleotide
aagaagcaauauga

SEQ ID NO: 1203 - RNA, 21 nt, Artificial Sequence
  synthetic oligonucleotide
ucacagugaaccggucucuuu

SEQ ID NO: 1204 - RNA, 20 nt, Artificial Sequence
  synthetic oligonucleotide
ucacagugaaccggucucuu

SEQ ID NO: 1205 - RNA, 14 nt, Artificial Sequence
  synthetic oligonucleotide
ccgguucacuguga

SEQ ID NO: 1206 - RNA, 17 nt, Artificial Sequence
  synthetic oligonucleotide
ucccaccgcugccaccc

SEQ ID NO: 1207 - RNA, 17 nt, Artificial Sequence
  synthetic oligonucleotide
ucccaccgcugccaccc

SEQ ID NO: 1208 - RNA, 14 nt, Artificial Sequence
  synthetic oligonucleotide
uggcagcgguggga

SEQ ID NO: 1209 - RNA, 17 nt, Artificial Sequence
  synthetic oligonucleotide
ucgccuccuccucuccc

SEQ ID NO: 1210 - RNA, 17 nt, Artificial Sequence
  synthetic oligonucleotide
ucgccuccuccucuccc

SEQ ID NO: 1211 - RNA, 14 nt, Artificial Sequence
  synthetic oligonucleotide
agaggaggaggcga

SEQ ID NO: 1212 - RNA, 20 nt, Artificial Sequence
  synthetic oligonucleotide
ucguuugccuuuuucugcuu

SEQ ID NO: 1213 - RNA, 20 nt, Artificial Sequence
  synthetic oligonucleotide
ucguuugccuuuuucugcuu

SEQ ID NO: 1214 - RNA, 14 nt, Artificial Sequence
  synthetic oligonucleotide
aaaaaggcaaacga

SEQ ID NO: 1215 - RNA, 22 nt, Artificial Sequence
  synthetic oligonucleotide
ucuacaaaggaaagcgcuuucu

SEQ ID NO: 1216 - RNA, 20 nt, Artificial Sequence
  synthetic oligonucleotide
ucuacaaaggaaagcgcuuu

SEQ ID NO: 1217 - RNA, 14 nt, Artificial Sequence
  synthetic oligonucleotide
cuuuccuuuguaga

SEQ ID NO: 1218 - RNA, 22 nt, Artificial Sequence
  synthetic oligonucleotide
ucuauacagacccuggcuuuuc

SEQ ID NO: 1219 - RNA, 20 nt, Artificial Sequence
  synthetic oligonucleotide
ucuauacagacccuggcuuu

SEQ ID NO: 1220 - RNA, 14 nt, Artificial Sequence
  synthetic oligonucleotide
agggucuguauaga

SEQ ID NO: 1221 - RNA, 22 nt, Artificial Sequence
  synthetic oligonucleotide
ucugggcaacaaagugagaccu

SEQ ID NO: 1222 - RNA, 20 nt, Artificial Sequence
  synthetic oligonucleotide
ucugggcaacaaagugagac

SEQ ID NO: 1223 - RNA, 14 nt, Artificial Sequence
  synthetic oligonucleotide
cuuuguugcccaga

SEQ ID NO: 1224 - RNA, 21 nt, Artificial Sequence
  synthetic oligonucleotide
ugcaggaccaagaugagcccu

SEQ ID NO: 1225 - RNA, 20 nt, Artificial Sequence
  synthetic oligonucleotide
ugcaggaccaagaugagccc

SEQ ID NO: 1226 - RNA, 14 nt, Artificial Sequence
  synthetic oligonucleotide
aucuugguccugca

SEQ ID NO: 1227 - RNA, 22 nt, Artificial Sequence
  synthetic oligonucleotide
ugcuggaucagugguucgaguc

SEQ ID NO: 1228 - RNA, 20 nt, Artificial Sequence
  synthetic oligonucleotide
ugcuggaucagugguucgag

SEQ ID NO: 1229 - RNA, 14 nt, Artificial Sequence
  synthetic oligonucleotide
ccacugauccagca

SEQ ID NO: 1230 - RNA, 21 nt, Artificial Sequence
  synthetic oligonucleotide
uggacugcccugaucuggaga

SEQ ID NO: 1231 - RNA, 20 nt, Artificial Sequence
  synthetic oligonucleotide
uggacugcccugaucuggag

SEQ ID NO: 1232 - RNA, 14 nt, Artificial Sequence
  synthetic oligonucleotide
aucagggcagucca

SEQ ID NO: 1233 - RNA, 23 nt, Artificial Sequence
  synthetic oligonucleotide
uggaguccaggaaucugcauuuu

SEQ ID NO: 1234 - RNA, 20 nt, Artificial Sequence
  synthetic oligonucleotide
uggaguccaggaaucugcau

SEQ ID NO: 1235 - RNA, 14 nt, Artificial Sequence
  synthetic oligonucleotide
auuccuggacucca

SEQ ID NO: 1236 - RNA, 22 nt, Artificial Sequence
  synthetic oligonucleotide
aagcccuuaccccaaaaaguau

SEQ ID NO: 1237 - RNA, 20 nt, Artificial Sequence
  synthetic oligonucleotide
aagcccuuaccccaaaaagu

SEQ ID NO: 1238 - RNA, 14 nt, Artificial Sequence
  synthetic oligonucleotide
ugggguaagggcuu

SEQ ID NO: 1239 - RNA, 19 nt, Artificial Sequence
  synthetic oligonucleotide
uggauuuuuggaucaggga

SEQ ID NO: 1240 - RNA, 19 nt, Artificial Sequence
  synthetic oligonucleotide
uggauuuuuggaucaggga

SEQ ID NO: 1241 - RNA, 14 nt, Artificial Sequence
  synthetic oligonucleotide
gauccaaaaaucca

SEQ ID NO: 1242 - RNA, 24 nt, Artificial Sequence
  synthetic oligonucleotide
uggcccugacugaagaccagcagu

SEQ ID NO: 1243 - RNA, 20 nt, Artificial Sequence
  synthetic oligonucleotide
uggcccugacugaagaccag

SEQ ID NO: 1244 - RNA, 14 nt, Artificial Sequence
  synthetic oligonucleotide
uucagucagggcca

SEQ ID NO: 1245 - RNA, 25 nt, Artificial Sequence
  synthetic oligonucleotide
ugggaacggguuccggcagacgcug

SEQ ID NO: 1246 - RNA, 20 nt, Artificial Sequence
  synthetic oligonucleotide
ugggaacggguuccggcaga

SEQ ID NO: 1247 - RNA, 14 nt, Artificial Sequence
  synthetic oligonucleotide
ggaacccguuccca

SEQ ID NO: 1248 - RNA, 22 nt, Artificial Sequence
  synthetic oligonucleotide
uggguggucuggagauuugugc

SEQ ID NO: 1249 - RNA, 20 nt, Artificial Sequence
  synthetic oligonucleotide
uggguggucuggagauuugu

SEQ ID NO: 1250 - RNA, 14 nt, Artificial Sequence
  synthetic oligonucleotide
cuccagaccaccca

SEQ ID NO: 1251 - RNA, 22 nt, Artificial Sequence
  synthetic oligonucleotide
aagcccuuaccccaaaaagcau

SEQ ID NO: 1252 - RNA, 20 nt, Artificial Sequence
  synthetic oligonucleotide
aagcccuuaccccaaaaagc

SEQ ID NO: 1253 - RNA, 14 nt, Artificial Sequence
  synthetic oligonucleotide
ugggguaagggcuu

SEQ ID NO: 1254 - RNA, 22 nt, Artificial Sequence
  synthetic oligonucleotide
ugugagguuggcauuguugucu

SEQ ID NO: 1255 - RNA, 20 nt, Artificial Sequence
  synthetic oligonucleotide
ugugagguuggcauuguugu

SEQ ID NO: 1256 - RNA, 14 nt, Artificial Sequence
  synthetic oligonucleotide
augccaaccucaca

SEQ ID NO: 1257 - RNA, 21 nt, Artificial Sequence
  synthetic oligonucleotide
uuaggccgcagaucuggguga

SEQ ID NO: 1258 - RNA, 20 nt, Artificial Sequence
  synthetic oligonucleotide
uuaggccgcagaucugggug

SEQ ID NO: 1259 - RNA, 14 nt, Artificial Sequence
  synthetic oligonucleotide
gaucugcggccuaa

SEQ ID NO: 1260 - RNA, 21 nt, Artificial Sequence
  synthetic oligonucleotide
cuuuuugcggucugggcuugc

SEQ ID NO: 1261 - RNA, 20 nt, Artificial Sequence
  synthetic oligonucleotide
cuuuuugcggucugggcuug

SEQ ID NO: 1262 - RNA, 14 nt, Artificial Sequence
  synthetic oligonucleotide
cagaccgcaaaaag

SEQ ID NO: 1263 - RNA, 22 nt, Artificial Sequence
  synthetic oligonucleotide
uuagggcccuggcuccaucucc

SEQ ID NO: 1264 - RNA, 20 nt, Artificial Sequence
  synthetic oligonucleotide
uuagggcccuggcuccaucu

SEQ ID NO: 1265 - RNA, 14 nt, Artificial Sequence
  synthetic oligonucleotide
agccagggcccuaa

SEQ ID NO: 1266 - RNA, 17 nt, Artificial Sequence
  synthetic oligonucleotide
uucaaguaauucaggug

SEQ ID NO: 1267 - RNA, 17 nt, Artificial Sequence
  synthetic oligonucleotide
uucaaguaauucaggug

SEQ ID NO: 1268 - RNA, 14 nt, Artificial Sequence
  synthetic oligonucleotide
cugaauuacuugaa

SEQ ID NO: 1269 - RNA, 22 nt, Artificial Sequence
  synthetic oligonucleotide
uucauucggcuguccagaugua

SEQ ID NO: 1270 - RNA, 20 nt, Artificial Sequence
  synthetic oligonucleotide
uucauucggcuguccagaug

SEQ ID NO: 1271 - RNA, 14 nt, Artificial Sequence
  synthetic oligonucleotide
gacagccgaaugaa

SEQ ID NO: 1272 - RNA, 22 nt, Artificial Sequence
  synthetic oligonucleotide
uucuggaauucugugugaggga

SEQ ID NO: 1273 - RNA, 20 nt, Artificial Sequence
  synthetic oligonucleotide
uucuggaauucugugugagg

SEQ ID NO: 1274 - RNA, 14 nt, Artificial Sequence
  synthetic oligonucleotide
acagaauuccagaa

SEQ ID NO: 1275 - RNA, 24 nt, Artificial Sequence
  synthetic oligonucleotide
uugcagcugccugggagugacuuc

SEQ ID NO: 1276 - RNA, 20 nt, Artificial Sequence
  synthetic oligonucleotide
uugcagcugccugggaguga

SEQ ID NO: 1277 - RNA, 14 nt, Artificial Sequence
  synthetic oligonucleotide
ccaggcagcugcaa

SEQ ID NO: 1278 - RNA, 21 nt, Artificial Sequence
  synthetic oligonucleotide
uugggacauacuuaugcuaaa

SEQ ID NO: 1279 - RNA, 20 nt, Artificial Sequence
  synthetic oligonucleotide
uugggacauacuuaugcuaa

SEQ ID NO: 1280 - RNA, 14 nt, Artificial Sequence
  synthetic oligonucleotide
uaaguaugucccaa

SEQ ID NO: 1281 - RNA, 22 nt, Artificial Sequence
  synthetic oligonucleotide
uuuagagacggggucuugcucu

SEQ ID NO: 1282 - RNA, 20 nt, Artificial Sequence
  synthetic oligonucleotide
uuuagagacggggucuugcu

SEQ ID NO: 1283 - RNA, 14 nt, Artificial Sequence
  synthetic oligonucleotide
accccgucucuaaa

SEQ ID NO: 1284 - RNA, 22 nt, Artificial Sequence
  synthetic oligonucleotide
uuugaggcuacagugagaugug

SEQ ID NO: 1285 - RNA, 20 nt, Artificial Sequence
  synthetic oligonucleotide
uuugaggcuacagugagaug

SEQ ID NO: 1286 - RNA, 14 nt, Artificial Sequence
  synthetic oligonucleotide
acuguagccucaaa

SEQ ID NO: 1287 - RNA, 22 nt, Artificial Sequence
  synthetic oligonucleotide
uuuucaacucuaaugggagaga

SEQ ID NO: 1288 - RNA, 20 nt, Artificial Sequence
  synthetic oligonucleotide
uuuucaacucuaaugggaga

SEQ ID NO: 1289 - RNA, 14 nt, Artificial Sequence
  synthetic oligonucleotide
auuagaguugaaaa

SEQ ID NO: 1290 - RNA, 18 nt, Artificial Sequence
  synthetic oligonucleotide
acguuggcucugguggug

SEQ ID NO: 1291 - RNA, 18 nt, Artificial Sequence
  synthetic oligonucleotide
acguuggcucugguggug

SEQ ID NO: 1292 - RNA, 14 nt, Artificial Sequence
  synthetic oligonucleotide
accagagccaacgu

SEQ ID NO: 1293 - RNA, 22 nt, Artificial Sequence
  synthetic oligonucleotide
acucggcguggcgucggucgug

SEQ ID NO: 1294 - RNA, 20 nt, Artificial Sequence
  synthetic oligonucleotide
acucggcguggcgucggucg

SEQ ID NO: 1295 - RNA, 14 nt, Artificial Sequence
  synthetic oligonucleotide
acgccacgccgagu

SEQ ID NO: 1296 - RNA, 22 nt, Artificial Sequence
  synthetic oligonucleotide
cagugcaauguuaaaagggcau

SEQ ID NO: 1297 - RNA, 20 nt, Artificial Sequence
  synthetic oligonucleotide
cagugcaauguuaaaagggc

SEQ ID NO: 1298 - RNA, 14 nt, Artificial Sequence
  synthetic oligonucleotide
uuaacauugcacug

SEQ ID NO: 1299 - RNA, 22 nt, Artificial Sequence
  synthetic oligonucleotide
uucacauugugcuacugucugc

SEQ ID NO: 1300 - RNA, 20 nt, Artificial Sequence
  synthetic oligonucleotide
uucacauugugcuacugucu

SEQ ID NO: 1301 - RNA, 14 nt, Artificial Sequence
  synthetic oligonucleotide
uagcacaaugugaa

SEQ ID NO: 1302 - RNA, 22 nt, Artificial Sequence
  synthetic oligonucleotide
cagugcaaugaugaaagggcau

SEQ ID NO: 1303 - RNA, 20 nt, Artificial Sequence
  synthetic oligonucleotide
cagugcaaugaugaaagggc

SEQ ID NO: 1304 - RNA, 14 nt, Artificial Sequence
  synthetic oligonucleotide
ucaucauugcacug

SEQ ID NO: 1305 - RNA, 21 nt, Artificial Sequence
  synthetic oligonucleotide
acucuuucccuguugcacuac

SEQ ID NO: 1306 - RNA, 20 nt, Artificial Sequence
  synthetic oligonucleotide
acucuuucccuguugcacua

SEQ ID NO: 1307 - RNA, 14 nt, Artificial Sequence
  synthetic oligonucleotide
aacagggaaagagu

SEQ ID NO: 1308 - RNA, 22 nt, Artificial Sequence
  synthetic oligonucleotide
uaacagucuacagccauggucg

SEQ ID NO: 1309 - RNA, 20 nt, Artificial Sequence
  synthetic oligonucleotide
uaacagucuacagccauggu

SEQ ID NO: 1310 - RNA, 14 nt, Artificial Sequence
  synthetic oligonucleotide
gcuguagacuguua

SEQ ID NO: 1311 - RNA, 22 nt, Artificial Sequence
  synthetic oligonucleotide
accguggcuuucgauuguuacu

SEQ ID NO: 1312 - RNA, 20 nt, Artificial Sequence
  synthetic oligonucleotide
accguggcuuucgauuguua

SEQ ID NO: 1313 - RNA, 14 nt, Artificial Sequence
  synthetic oligonucleotide
ucgaaagccacggu

SEQ ID NO: 1314 - RNA, 18 nt, Artificial Sequence
  synthetic oligonucleotide
cagggaggugaaugugau

SEQ ID NO: 1315 - RNA, 18 nt, Artificial Sequence
  synthetic oligonucleotide
cagggaggugaaugugau

SEQ ID NO: 1316 - RNA, 14 nt, Artificial Sequence
  synthetic oligonucleotide
cauucaccucccug

SEQ ID NO: 1317 - RNA, 19 nt, Artificial Sequence
  synthetic oligonucleotide
gaugaugcugcugaugcug

SEQ ID NO: 1318 - RNA, 19 nt, Artificial Sequence
  synthetic oligonucleotide
gaugaugcugcugaugcug

SEQ ID NO: 1319 - RNA, 14 nt, Artificial Sequence
  synthetic oligonucleotide
ucagcagcaucauc

SEQ ID NO: 1320 - RNA, 22 nt, Artificial Sequence
  synthetic oligonucleotide
ucaaaacugaggggcauuuucu

SEQ ID NO: 1321 - RNA, 20 nt, Artificial Sequence
  synthetic oligonucleotide
ucaaaacugaggggcauuuu

SEQ ID NO: 1322 - RNA, 14 nt, Artificial Sequence
  synthetic oligonucleotide
ccccucaguuuuga

SEQ ID NO: 1323 - RNA, 24 nt, Artificial Sequence
  synthetic oligonucleotide
ccagacagaauucuaugcacuuuc

SEQ ID NO: 1324 - RNA, 20 nt, Artificial Sequence
  synthetic oligonucleotide
ccagacagaauucuaugcac

SEQ ID NO: 1325 - RNA, 14 nt, Artificial Sequence
  synthetic oligonucleotide
agaauucugucugg

SEQ ID NO: 1326 - RNA, 22 nt, Artificial Sequence
  synthetic oligonucleotide
uuugguccccuucaaccagcug

SEQ ID NO: 1327 - RNA, 20 nt, Artificial Sequence
  synthetic oligonucleotide
uuugguccccuucaaccagc

SEQ ID NO: 1328 - RNA, 14 nt, Artificial Sequence
  synthetic oligonucleotide
ugaaggggaccaaa

SEQ ID NO: 1329 - RNA, 22 nt, Artificial Sequence
  synthetic oligonucleotide
uuugguccccuucaaccagcua

SEQ ID NO: 1330 - RNA, 20 nt, Artificial Sequence
  synthetic oligonucleotide
uuugguccccuucaaccagc

SEQ ID NO: 1331 - RNA, 14 nt, Artificial Sequence
  synthetic oligonucleotide
ugaaggggaccaaa

SEQ ID NO: 1332 - RNA, 22 nt, Artificial Sequence
  synthetic oligonucleotide
ugugacugguugaccagagggg

SEQ ID NO: 1333 - RNA, 20 nt, Artificial Sequence
  synthetic oligonucleotide
ugugacugguugaccagagg

SEQ ID NO: 1334 - RNA, 14 nt, Artificial Sequence
  synthetic oligonucleotide
gucaaccagucaca

SEQ ID NO: 1335 - RNA, 23 nt, Artificial Sequence
  synthetic oligonucleotide
uauggcuuuuuauuccuauguga

SEQ ID NO: 1336 - RNA, 20 nt, Artificial Sequence
  synthetic oligonucleotide
uauggcuuuuuauuccuaug

SEQ ID NO: 1337 - RNA, 14 nt, Artificial Sequence
  synthetic oligonucleotide
aauaaaaagccaua

SEQ ID NO: 1338 - RNA, 22 nt, Artificial Sequence
  synthetic oligonucleotide
uauagggauuggagccguggcg

SEQ ID NO: 1339 - RNA, 20 nt, Artificial Sequence
  synthetic oligonucleotide
uauagggauuggagccgugg

SEQ ID NO: 1340 - RNA, 14 nt, Artificial Sequence
  synthetic oligonucleotide
cuccaaucccuaua

SEQ ID NO: 1341 - RNA, 23 nt, Artificial Sequence
  synthetic oligonucleotide
uauggcuuuucauuccuauguga

SEQ ID NO: 1342 - RNA, 20 nt, Artificial Sequence
  synthetic oligonucleotide
uauggcuuuucauuccuaug

SEQ ID NO: 1343 - RNA, 14 nt, Artificial Sequence
  synthetic oligonucleotide
aaugaaaagccaua

SEQ ID NO: 1344 - RNA, 22 nt, Artificial Sequence
  synthetic oligonucleotide
auguagggcuaaaagccauggg

SEQ ID NO: 1345 - RNA, 20 nt, Artificial Sequence
  synthetic oligonucleotide
auguagggcuaaaagccaug

SEQ ID NO: 1346 - RNA, 14 nt, Artificial Sequence
  synthetic oligonucleotide
uuuuagcccuacau

SEQ ID NO: 1347 - RNA, 23 nt, Artificial Sequence
  synthetic oligonucleotide
acuccauuuguuuugaugaugga

SEQ ID NO: 1348 - RNA, 20 nt, Artificial Sequence
  synthetic oligonucleotide
acuccauuuguuuugaugau

SEQ ID NO: 1349 - RNA, 14 nt, Artificial Sequence
  synthetic oligonucleotide
aaaacaaauggagu

SEQ ID NO: 1350 - RNA, 22 nt, Artificial Sequence
  synthetic oligonucleotide
caucaucgucucaaaugagucu

SEQ ID NO: 1351 - RNA, 20 nt, Artificial Sequence
  synthetic oligonucleotide
caucaucgucucaaaugagu

SEQ ID NO: 1352 - RNA, 14 nt, Artificial Sequence
  synthetic oligonucleotide
uugagacgaugaug

SEQ ID NO: 1353 - RNA, 23 nt, Artificial Sequence
  synthetic oligonucleotide
uuauugcuuaagaauacgcguag

SEQ ID NO: 1354 - RNA, 20 nt, Artificial Sequence
  synthetic oligonucleotide
uuauugcuuaagaauacgcg

SEQ ID NO: 1355 - RNA, 14 nt, Artificial Sequence
  synthetic oligonucleotide
uucuuaagcaauaa

SEQ ID NO: 1356 - RNA, 23 nt, Artificial Sequence
  synthetic oligonucleotide
agcugguguugugaaucaggccg

SEQ ID NO: 1357 - RNA, 20 nt, Artificial Sequence
  synthetic oligonucleotide
agcugguguugugaaucagg

SEQ ID NO: 1358 - RNA, 14 nt, Artificial Sequence
  synthetic oligonucleotide
ucacaacaccagcu

SEQ ID NO: 1359 - RNA, 22 nt, Artificial Sequence
  synthetic oligonucleotide
gcuacuucacaacaccagggcc

SEQ ID NO: 1360 - RNA, 20 nt, Artificial Sequence
  synthetic oligonucleotide
gcuacuucacaacaccaggg

SEQ ID NO: 1361 - RNA, 14 nt, Artificial Sequence
  synthetic oligonucleotide
uguugugaaguagc

SEQ ID NO: 1362 - RNA, 22 nt, Artificial Sequence
  synthetic oligonucleotide
gcuauuucacgacaccaggguu

SEQ ID NO: 1363 - RNA, 20 nt, Artificial Sequence
  synthetic oligonucleotide
gcuauuucacgacaccaggg

SEQ ID NO: 1364 - RNA, 14 nt, Artificial Sequence
  synthetic oligonucleotide
ugucgugaaauagc

SEQ ID NO: 1365 - RNA, 22 nt, Artificial Sequence
  synthetic oligonucleotide
ggagacgcggcccuguuggagu

SEQ ID NO: 1366 - RNA, 20 nt, Artificial Sequence
  synthetic oligonucleotide
ggagacgcggcccuguugga

SEQ ID NO: 1367 - RNA, 14 nt, Artificial Sequence
  synthetic oligonucleotide
agggccgcgucucc

SEQ ID NO: 1368 - RNA, 22 nt, Artificial Sequence
  synthetic oligonucleotide
ucuacagugcacgugucuccag

SEQ ID NO: 1369 - RNA, 20 nt, Artificial Sequence
  synthetic oligonucleotide
ucuacagugcacgugucucc

SEQ ID NO: 1370 - RNA, 14 nt, Artificial Sequence
  synthetic oligonucleotide
acgugcacuguaga

SEQ ID NO: 1371 - RNA, 21 nt, Artificial Sequence
  synthetic oligonucleotide
uaccacaggguagaaccacgg

SEQ ID NO: 1372 - RNA, 20 nt, Artificial Sequence
  synthetic oligonucleotide
uaccacaggguagaaccacg

SEQ ID NO: 1373 - RNA, 14 nt, Artificial Sequence
  synthetic oligonucleotide
ucuacccuguggua

SEQ ID NO: 1374 - RNA, 22 nt, Artificial Sequence
  synthetic oligonucleotide
cagugguuuuacccuaugguag

SEQ ID NO: 1375 - RNA, 20 nt, Artificial Sequence
  synthetic oligonucleotide
cagugguuuuacccuauggu

SEQ ID NO: 1376 - RNA, 14 nt, Artificial Sequence
  synthetic oligonucleotide
ggguaaaaccacug

SEQ ID NO: 1377 - RNA, 22 nt, Artificial Sequence
  synthetic oligonucleotide
uaacacugucugguaaagaugg

SEQ ID NO: 1378 - RNA, 20 nt, Artificial Sequence
  synthetic oligonucleotide
uaacacugucugguaaagau

SEQ ID NO: 1379 - RNA, 14 nt, Artificial Sequence
  synthetic oligonucleotide
accagacaguguua

SEQ ID NO: 1380 - RNA, 22 nt, Artificial Sequence
  synthetic oligonucleotide
caucuuccaguacaguguugga

SEQ ID NO: 1381 - RNA, 20 nt, Artificial Sequence
  synthetic oligonucleotide
caucuuccaguacaguguug

SEQ ID NO: 1382 - RNA, 14 nt, Artificial Sequence
  synthetic oligonucleotide
uguacuggaagaug

SEQ ID NO: 1383 - RNA, 23 nt, Artificial Sequence
  synthetic oligonucleotide
uguaguguuuccuacuuuaugga

SEQ ID NO: 1384 - RNA, 20 nt, Artificial Sequence
  synthetic oligonucleotide
uguaguguuuccuacuuuau

SEQ ID NO: 1385 - RNA, 14 nt, Artificial Sequence
  synthetic oligonucleotide
uaggaaacacuaca

SEQ ID NO: 1386 - RNA, 21 nt, Artificial Sequence
  synthetic oligonucleotide
cauaaaguagaaagcacuacu

SEQ ID NO: 1387 - RNA, 20 nt, Artificial Sequence
  synthetic oligonucleotide
cauaaaguagaaagcacuac

SEQ ID NO: 1388 - RNA, 14 nt, Artificial Sequence
  synthetic oligonucleotide
cuuucuacuuuaug

SEQ ID NO: 1389 - RNA, 21 nt, Artificial Sequence
  synthetic oligonucleotide
ugagaugaagcacuguagcuc

SEQ ID NO: 1390 - RNA, 20 nt, Artificial Sequence
  synthetic oligonucleotide
ugagaugaagcacuguagcu

SEQ ID NO: 1391 - RNA, 14 nt, Artificial Sequence
  synthetic oligonucleotide
agugcuucaucuca

SEQ ID NO: 1392 - RNA, 22 nt, Artificial Sequence
  synthetic oligonucleotide
ggugcagugcugcaucucuggu

SEQ ID NO: 1393 - RNA, 20 nt, Artificial Sequence
  synthetic oligonucleotide
ggugcagugcugcaucucug

SEQ ID NO: 1394 - RNA, 14 nt, Artificial Sequence
  synthetic oligonucleotide
ugcagcacugcacc

SEQ ID NO: 1395 - RNA, 20 nt, Artificial Sequence
  synthetic oligonucleotide
uacaguauagaugauguacu

SEQ ID NO: 1396 - RNA, 20 nt, Artificial Sequence
  synthetic oligonucleotide
uacaguauagaugauguacu

SEQ ID NO: 1397 - RNA, 14 nt, Artificial Sequence
  synthetic oligonucleotide
ucaucuauacugua

SEQ ID NO: 1398 - RNA, 22 nt, Artificial Sequence
  synthetic oligonucleotide
ggauaucaucauauacuguaag

SEQ ID NO: 1399 - RNA, 20 nt, Artificial Sequence
  synthetic oligonucleotide
ggauaucaucauauacugua

SEQ ID NO: 1400 - RNA, 14 nt, Artificial Sequence
  synthetic oligonucleotide
auaugaugauaucc

SEQ ID NO: 1401 - RNA, 23 nt, Artificial Sequence
  synthetic oligonucleotide
guccaguuuucccaggaaucccu

SEQ ID NO: 1402 - RNA, 20 nt, Artificial Sequence
  synthetic oligonucleotide
guccaguuuucccaggaauc

SEQ ID NO: 1403 - RNA, 14 nt, Artificial Sequence
  synthetic oligonucleotide
ugggaaaacuggac

SEQ ID NO: 1404 - RNA, 22 nt, Artificial Sequence
  synthetic oligonucleotide
ggauuccuggaaauacuguucu

SEQ ID NO: 1405 - RNA, 20 nt, Artificial Sequence
  synthetic oligonucleotide
ggauuccuggaaauacuguu

SEQ ID NO: 1406 - RNA, 14 nt, Artificial Sequence
  synthetic oligonucleotide
auuuccaggaaucc

SEQ ID NO: 1407 - RNA, 21 nt, Artificial Sequence
  synthetic oligonucleotide
cuccguuugccuguuucgcug

SEQ ID NO: 1408 - RNA, 20 nt, Artificial Sequence
  synthetic oligonucleotide
cuccguuugccuguuucgcu

SEQ ID NO: 1409 - RNA, 14 nt, Artificial Sequence
  synthetic oligonucleotide
acaggcaaacggag

SEQ ID NO: 1410 - RNA, 22 nt, Artificial Sequence
  synthetic oligonucleotide
cucggcgcggggcgcgggcucc

SEQ ID NO: 1411 - RNA, 20 nt, Artificial Sequence
  synthetic oligonucleotide
cucggcgcggggcgcgggcu

SEQ ID NO: 1412 - RNA, 14 nt, Artificial Sequence
  synthetic oligonucleotide
cgccccgcgccgag

SEQ ID NO: 1413 - RNA, 22 nt, Artificial Sequence
  synthetic oligonucleotide
ugagaacugaauuccauggguu

SEQ ID NO: 1414 - RNA, 20 nt, Artificial Sequence
  synthetic oligonucleotide
ugagaacugaauuccauggg

SEQ ID NO: 1415 - RNA, 14 nt, Artificial Sequence
  synthetic oligonucleotide
gaauucaguucuca

SEQ ID NO: 1416 - RNA, 22 nt, Artificial Sequence
  synthetic oligonucleotide
ccucugaaauucaguucuucag

SEQ ID NO: 1417 - RNA, 20 nt, Artificial Sequence
  synthetic oligonucleotide
ccucugaaauucaguucuuc

SEQ ID NO: 1418 - RNA, 14 nt, Artificial Sequence
  synthetic oligonucleotide
cugaauuucagagg

SEQ ID NO: 1419 - RNA, 22 nt, Artificial Sequence
  synthetic oligonucleotide
ugcccuguggacucaguucugg

SEQ ID NO: 1420 - RNA, 20 nt, Artificial Sequence
  synthetic oligonucleotide
ugcccuguggacucaguucu

SEQ ID NO: 1421 - RNA, 14 nt, Artificial Sequence
  synthetic oligonucleotide
gaguccacagggca

SEQ ID NO: 1422 - RNA, 22 nt, Artificial Sequence
  synthetic oligonucleotide
ugagaacugaauuccauaggcu

SEQ ID NO: 1423 - RNA, 20 nt, Artificial Sequence
  synthetic oligonucleotide
ugagaacugaauuccauagg

SEQ ID NO: 1424 - RNA, 14 nt, Artificial Sequence
  synthetic oligonucleotide
gaauucaguucuca

SEQ ID NO: 1425 - RNA, 20 nt, Artificial Sequence
  synthetic oligonucleotide
guguguggaaaugcuucugc

SEQ ID NO: 1426 - RNA, 20 nt, Artificial Sequence
  synthetic oligonucleotide
guguguggaaaugcuucugc

SEQ ID NO: 1427 - RNA, 14 nt, Artificial Sequence
  synthetic oligonucleotide
gcauuuccacacac

SEQ ID NO: 1428 - RNA, 21 nt, Artificial Sequence
  synthetic oligonucleotide
gcccuccgcccgugcaccccg

SEQ ID NO: 1429 - RNA, 20 nt, Artificial Sequence
  synthetic oligonucleotide
gcccuccgcccgugcacccc

SEQ ID NO: 1430 - RNA, 14 nt, Artificial Sequence
  synthetic oligonucleotide
cacgggcggagggc

SEQ ID NO: 1431 - RNA, 22 nt, Artificial Sequence
  synthetic oligonucleotide
gcccgcguguggagccaggugu

SEQ ID NO: 1432 - RNA, 20 nt, Artificial Sequence
  synthetic oligonucleotide
gcccgcguguggagccaggu

SEQ ID NO: 1433 - RNA, 14 nt, Artificial Sequence
  synthetic oligonucleotide
cuccacacgcgggc

SEQ ID NO: 1434 - RNA, 22 nt, Artificial Sequence
  synthetic oligonucleotide
gugugcggaaaugcuucugcua

SEQ ID NO: 1435 - RNA, 20 nt, Artificial Sequence
  synthetic oligonucleotide
gugugcggaaaugcuucugc

SEQ ID NO: 1436 - RNA, 14 nt, Artificial Sequence
  synthetic oligonucleotide
gcauuuccgcacac

SEQ ID NO: 1437 - RNA, 22 nt, Artificial Sequence
  synthetic oligonucleotide
ucagugcacuacagaacuuugu

SEQ ID NO: 1438 - RNA, 20 nt, Artificial Sequence
  synthetic oligonucleotide
ucagugcacuacagaacuuu

SEQ ID NO: 1439 - RNA, 14 nt, Artificial Sequence
  synthetic oligonucleotide
cuguagugcacuga

SEQ ID NO: 1440 - RNA, 22 nt, Artificial Sequence
  synthetic oligonucleotide
aaaguucugagacacuccgacu

SEQ ID NO: 1441 - RNA, 20 nt, Artificial Sequence
  synthetic oligonucleotide
aaaguucugagacacuccga

SEQ ID NO: 1442 - RNA, 14 nt, Artificial Sequence
  synthetic oligonucleotide
ugucucagaacuuu

SEQ ID NO: 1443 - RNA, 22 nt, Artificial Sequence
  synthetic oligonucleotide
ucagugcaucacagaacuuugu

SEQ ID NO: 1444 - RNA, 20 nt, Artificial Sequence
  synthetic oligonucleotide
ucagugcaucacagaacuuu

SEQ ID NO: 1445 - RNA, 14 nt, Artificial Sequence
  synthetic oligonucleotide
cugugaugcacuga

SEQ ID NO: 1446 - RNA, 22 nt, Artificial Sequence
  synthetic oligonucleotide
aaguucuguuauacacucaggc

SEQ ID NO: 1447 - RNA, 20 nt, Artificial Sequence
  synthetic oligonucleotide
aaguucuguuauacacucag

SEQ ID NO: 1448 - RNA, 14 nt, Artificial Sequence
  synthetic oligonucleotide
guauaacagaacuu

SEQ ID NO: 1449 - RNA, 23 nt, Artificial Sequence
  synthetic oligonucleotide
ucuggcuccgugucuucacuccc

SEQ ID NO: 1450 - RNA, 20 nt, Artificial Sequence
  synthetic oligonucleotide
ucuggcuccgugucuucacu

SEQ ID NO: 1451 - RNA, 14 nt, Artificial Sequence
  synthetic oligonucleotide
gacacggagccaga

SEQ ID NO: 1452 - RNA, 21 nt, Artificial Sequence
  synthetic oligonucleotide
agggagggacgggggcugugc

SEQ ID NO: 1453 - RNA, 20 nt, Artificial Sequence
  synthetic oligonucleotide
agggagggacgggggcugug

SEQ ID NO: 1454 - RNA, 14 nt, Artificial Sequence
  synthetic oligonucleotide
ccccgucccucccu

SEQ ID NO: 1455 - RNA, 22 nt, Artificial Sequence
  synthetic oligonucleotide
ucucccaacccuuguaccagug

SEQ ID NO: 1456 - RNA, 20 nt, Artificial Sequence
  synthetic oligonucleotide
ucucccaacccuuguaccag

SEQ ID NO: 1457 - RNA, 14 nt, Artificial Sequence
  synthetic oligonucleotide
caaggguugggaga

SEQ ID NO: 1458 - RNA, 22 nt, Artificial Sequence
  synthetic oligonucleotide
cugguacaggccugggggacag

SEQ ID NO: 1459 - RNA, 20 nt, Artificial Sequence
  synthetic oligonucleotide
cugguacaggccugggggac

SEQ ID NO: 1460 - RNA, 14 nt, Artificial Sequence
  synthetic oligonucleotide
caggccuguaccag

SEQ ID NO: 1461 - RNA, 21 nt, Artificial Sequence
  synthetic oligonucleotide
cuagacugaagcuccuugagg

SEQ ID NO: 1462 - RNA, 20 nt, Artificial Sequence
  synthetic oligonucleotide
cuagacugaagcuccuugag

SEQ ID NO: 1463 - RNA, 14 nt, Artificial Sequence
  synthetic oligonucleotide
gagcuucagucuag

SEQ ID NO: 1464 - RNA, 21 nt, Artificial Sequence
  synthetic oligonucleotide
ucgaggagcucacagucuagu

SEQ ID NO: 1465 - RNA, 20 nt, Artificial Sequence
  synthetic oligonucleotide
ucgaggagcucacagucuag

SEQ ID NO: 1466 - RNA, 14 nt, Artificial Sequence
  synthetic oligonucleotide
ugugagcuccucga

SEQ ID NO: 1467 - RNA, 21 nt, Artificial Sequence
  synthetic oligonucleotide
ucagugcaugacagaacuugg

SEQ ID NO: 1468 - RNA, 20 nt, Artificial Sequence
  synthetic oligonucleotide
ucagugcaugacagaacuug

SEQ ID NO: 1469 - RNA, 14 nt, Artificial Sequence
  synthetic oligonucleotide
cugucaugcacuga

SEQ ID NO: 1470 - RNA, 22 nt, Artificial Sequence
  synthetic oligonucleotide
uugcauagucacaaaagugauc

SEQ ID NO: 1471 - RNA, 20 nt, Artificial Sequence
  synthetic oligonucleotide
uugcauagucacaaaaguga

SEQ ID NO: 1472 - RNA, 14 nt, Artificial Sequence
  synthetic oligonucleotide
uugugacuaugcaa

SEQ ID NO: 1473 - RNA, 22 nt, Artificial Sequence
  synthetic oligonucleotide
aaaaccgucuaguuacaguugu

SEQ ID NO: 1474 - RNA, 20 nt, Artificial Sequence
  synthetic oligonucleotide
aaaaccgucuaguuacaguu

SEQ ID NO: 1475 - RNA, 14 nt, Artificial Sequence
  synthetic oligonucleotide
aacuagacgguuuu

SEQ ID NO: 1476 - RNA, 23 nt, Artificial Sequence
  synthetic oligonucleotide
cggcccgggcugcugcuguuccu

SEQ ID NO: 1477 - RNA, 20 nt, Artificial Sequence
  synthetic oligonucleotide
cggcccgggcugcugcuguu

SEQ ID NO: 1478 - RNA, 14 nt, Artificial Sequence
  synthetic oligonucleotide
agcagcccgggccg

SEQ ID NO: 1479 - RNA, 21 nt, Artificial Sequence
  synthetic oligonucleotide
uccugcgcgucccagaugccc

SEQ ID NO: 1480 - RNA, 20 nt, Artificial Sequence
  synthetic oligonucleotide
uccugcgcgucccagaugcc

SEQ ID NO: 1481 - RNA, 14 nt, Artificial Sequence
  synthetic oligonucleotide
ugggacgcgcagga

SEQ ID NO: 1482 - RNA, 22 nt, Artificial Sequence
  synthetic oligonucleotide
uagguuauccguguugccuucg

SEQ ID NO: 1483 - RNA, 20 nt, Artificial Sequence
  synthetic oligonucleotide
uagguuauccguguugccuu

SEQ ID NO: 1484 - RNA, 14 nt, Artificial Sequence
  synthetic oligonucleotide
acacggauaaccua

SEQ ID NO: 1485 - RNA, 22 nt, Artificial Sequence
  synthetic oligonucleotide
aaucauacacgguugaccuauu

SEQ ID NO: 1486 - RNA, 20 nt, Artificial Sequence
  synthetic oligonucleotide
aaucauacacgguugaccua

SEQ ID NO: 1487 - RNA, 14 nt, Artificial Sequence
  synthetic oligonucleotide
aaccguguaugauu

SEQ ID NO: 1488 - RNA, 23 nt, Artificial Sequence
  synthetic oligonucleotide
uuaaugcuaaucgugauaggggu

SEQ ID NO: 1489 - RNA, 20 nt, Artificial Sequence
  synthetic oligonucleotide
uuaaugcuaaucgugauagg

SEQ ID NO: 1490 - RNA, 14 nt, Artificial Sequence
  synthetic oligonucleotide
acgauuagcauuaa

SEQ ID NO: 1491 - RNA, 22 nt, Artificial Sequence
  synthetic oligonucleotide
cuccuacauauuagcauuaaca

SEQ ID NO: 1492 - RNA, 20 nt, Artificial Sequence
  synthetic oligonucleotide
cuccuacauauuagcauuaa

SEQ ID NO: 1493 - RNA, 14 nt, Artificial Sequence
  synthetic oligonucleotide
cuaauauguaggag

SEQ ID NO: 1494 - RNA, 22 nt, Artificial Sequence
  synthetic oligonucleotide
uagcagcacauaaugguuugug

SEQ ID NO: 1495 - RNA, 20 nt, Artificial Sequence
  synthetic oligonucleotide
uagcagcacauaaugguuug

SEQ ID NO: 1496 - RNA, 14 nt, Artificial Sequence
  synthetic oligonucleotide
auuaugugcugcua

SEQ ID NO: 1497 - RNA, 22 nt, Artificial Sequence
  synthetic oligonucleotide
caggccauauugugcugccuca

SEQ ID NO: 1498 - RNA, 20 nt, Artificial Sequence
  synthetic oligonucleotide
caggccauauugugcugccu

SEQ ID NO: 1499 - RNA, 14 nt, Artificial Sequence
  synthetic oligonucleotide
cacaauauggccug

SEQ ID NO: 1500 - RNA, 22 nt, Artificial Sequence
  synthetic oligonucleotide
uagcagcacaucaugguuuaca

SEQ ID NO: 1501 - RNA, 20 nt, Artificial Sequence
  synthetic oligonucleotide
uagcagcacaucaugguuua

SEQ ID NO: 1502 - RNA, 14 nt, Artificial Sequence
  synthetic oligonucleotide
augaugugcugcua

SEQ ID NO: 1503 - RNA, 22 nt, Artificial Sequence
  synthetic oligonucleotide
cgaaucauuauuugcugcucua

SEQ ID NO: 1504 - RNA, 20 nt, Artificial Sequence
  synthetic oligonucleotide
cgaaucauuauuugcugcuc

SEQ ID NO: 1505 - RNA, 14 nt, Artificial Sequence
  synthetic oligonucleotide
caaauaaugauucg

SEQ ID NO: 1506 - RNA, 22 nt, Artificial Sequence
  synthetic oligonucleotide
uagcagcacguaaauauuggcg

SEQ ID NO: 1507 - RNA, 20 nt, Artificial Sequence
  synthetic oligonucleotide
uagcagcacguaaauauugg

SEQ ID NO: 1508 - RNA, 14 nt, Artificial Sequence
  synthetic oligonucleotide
uuuacgugcugcua

SEQ ID NO: 1509 - RNA, 22 nt, Artificial Sequence
  synthetic oligonucleotide
ccaguauuaacugugcugcuga

SEQ ID NO: 1510 - RNA, 20 nt, Artificial Sequence
  synthetic oligonucleotide
ccaguauuaacugugcugcu

SEQ ID NO: 1511 - RNA, 14 nt, Artificial Sequence
  synthetic oligonucleotide
acaguuaauacugg

SEQ ID NO: 1512 - RNA, 22 nt, Artificial Sequence
  synthetic oligonucleotide
ccaauauuacugugcugcuuua

SEQ ID NO: 1513 - RNA, 20 nt, Artificial Sequence
  synthetic oligonucleotide
ccaauauuacugugcugcuu

SEQ ID NO: 1514 - RNA, 14 nt, Artificial Sequence
  synthetic oligonucleotide
cacaguaauauugg

SEQ ID NO: 1515 - RNA, 23 nt, Artificial Sequence
  synthetic oligonucleotide
caaagugcuuacagugcagguag

SEQ ID NO: 1516 - RNA, 20 nt, Artificial Sequence
  synthetic oligonucleotide
caaagugcuuacagugcagg

SEQ ID NO: 1517 - RNA, 14 nt, Artificial Sequence
  synthetic oligonucleotide
cuguaagcacuuug

SEQ ID NO: 1518 - RNA, 22 nt, Artificial Sequence
  synthetic oligonucleotide
acugcagugaaggcacuuguag

SEQ ID NO: 1519 - RNA, 20 nt, Artificial Sequence
  synthetic oligonucleotide
acugcagugaaggcacuugu

SEQ ID NO: 1520 - RNA, 14 nt, Artificial Sequence
  synthetic oligonucleotide
gccuucacugcagu

SEQ ID NO: 1521 - RNA, 23 nt, Artificial Sequence
  synthetic oligonucleotide
aacauucaacgcugucggugagu

SEQ ID NO: 1522 - RNA, 20 nt, Artificial Sequence
  synthetic oligonucleotide
aacauucaacgcugucggug

SEQ ID NO: 1523 - RNA, 14 nt, Artificial Sequence
  synthetic oligonucleotide
cagcguugaauguu

SEQ ID NO: 1524 - RNA, 22 nt, Artificial Sequence
  synthetic oligonucleotide
accaucgaccguugauuguacc

SEQ ID NO: 1525 - RNA, 20 nt, Artificial Sequence
  synthetic oligonucleotide
accaucgaccguugauugua

SEQ ID NO: 1526 - RNA, 14 nt, Artificial Sequence
  synthetic oligonucleotide
caacggucgauggu

SEQ ID NO: 1527 - RNA, 22 nt, Artificial Sequence
  synthetic oligonucleotide
accacugaccguugacuguacc

SEQ ID NO: 1528 - RNA, 20 nt, Artificial Sequence
  synthetic oligonucleotide
accacugaccguugacugua

SEQ ID NO: 1529 - RNA, 14 nt, Artificial Sequence
  synthetic oligonucleotide
caacggucaguggu

SEQ ID NO: 1530 - RNA, 23 nt, Artificial Sequence
  synthetic oligonucleotide
aacauucauugcugucggugggu

SEQ ID NO: 1531 - RNA, 20 nt, Artificial Sequence
  synthetic oligonucleotide
aacauucauugcugucggug

SEQ ID NO: 1532 - RNA, 14 nt, Artificial Sequence
  synthetic oligonucleotide
cagcaaugaauguu

SEQ ID NO: 1533 - RNA, 22 nt, Artificial Sequence
  synthetic oligonucleotide
aacauucaaccugucggugagu

SEQ ID NO: 1534 - RNA, 20 nt, Artificial Sequence
  synthetic oligonucleotide
aacauucaaccugucgguga

SEQ ID NO: 1535 - RNA, 14 nt, Artificial Sequence
  synthetic oligonucleotide
acagguugaauguu

SEQ ID NO: 1536 - RNA, 22 nt, Artificial Sequence
  synthetic oligonucleotide
aaccaucgaccguugaguggac

SEQ ID NO: 1537 - RNA, 20 nt, Artificial Sequence
  synthetic oligonucleotide
aaccaucgaccguugagugg

SEQ ID NO: 1538 - RNA, 14 nt, Artificial Sequence
  synthetic oligonucleotide
aacggucgaugguu

SEQ ID NO: 1539 - RNA, 23 nt, Artificial Sequence
  synthetic oligonucleotide
aacauucauuguugucggugggu

SEQ ID NO: 1540 - RNA, 20 nt, Artificial Sequence
  synthetic oligonucleotide
aacauucauuguugucggug

SEQ ID NO: 1541 - RNA, 14 nt, Artificial Sequence
  synthetic oligonucleotide
caacaaugaauguu

SEQ ID NO: 1542 - RNA, 24 nt, Artificial Sequence
  synthetic oligonucleotide
uuuggcaaugguagaacucacacu

SEQ ID NO: 1543 - RNA, 20 nt, Artificial Sequence
  synthetic oligonucleotide
uuuggcaaugguagaacuca

SEQ ID NO: 1544 - RNA, 14 nt, Artificial Sequence
  synthetic oligonucleotide
cuaccauugccaaa

SEQ ID NO: 1545 - RNA, 21 nt, Artificial Sequence
  synthetic oligonucleotide
ugguucuagacuugccaacua

SEQ ID NO: 1546 - RNA, 20 nt, Artificial Sequence
  synthetic oligonucleotide
ugguucuagacuugccaacu

SEQ ID NO: 1547 - RNA, 14 nt, Artificial Sequence
  synthetic oligonucleotide
caagucuagaacca

SEQ ID NO: 1548 - RNA, 18 nt, Artificial Sequence
  synthetic oligonucleotide
uccagugcccuccucucc

SEQ ID NO: 1549 - RNA, 18 nt, Artificial Sequence
  synthetic oligonucleotide
uccagugcccuccucucc

SEQ ID NO: 1550 - RNA, 14 nt, Artificial Sequence
  synthetic oligonucleotide
aggagggcacugga

SEQ ID NO: 1551 - RNA, 18 nt, Artificial Sequence
  synthetic oligonucleotide
ugaggcaguagauugaau

SEQ ID NO: 1552 - RNA, 18 nt, Artificial Sequence
  synthetic oligonucleotide
ugaggcaguagauugaau

SEQ ID NO: 1553 - RNA, 14 nt, Artificial Sequence
  synthetic oligonucleotide
aaucuacugccuca

SEQ ID NO: 1554 - RNA, 22 nt, Artificial Sequence
  synthetic oligonucleotide
uauggcacugguagaauucacu

SEQ ID NO: 1555 - RNA, 20 nt, Artificial Sequence
  synthetic oligonucleotide
uauggcacugguagaauuca

SEQ ID NO: 1556 - RNA, 14 nt, Artificial Sequence
  synthetic oligonucleotide
cuaccagugccaua

SEQ ID NO: 1557 - RNA, 22 nt, Artificial Sequence
  synthetic oligonucleotide
gugaauuaccgaagggccauaa

SEQ ID NO: 1558 - RNA, 20 nt, Artificial Sequence
  synthetic oligonucleotide
gugaauuaccgaagggccau

SEQ ID NO: 1559 - RNA, 14 nt, Artificial Sequence
  synthetic oligonucleotide
cuucgguaauucac

SEQ ID NO: 1560 - RNA, 22 nt, Artificial Sequence
  synthetic oligonucleotide
uggacggagaacugauaagggu

SEQ ID NO: 1561 - RNA, 20 nt, Artificial Sequence
  synthetic oligonucleotide
uggacggagaacugauaagg

SEQ ID NO: 1562 - RNA, 14 nt, Artificial Sequence
  synthetic oligonucleotide
caguucuccgucca

SEQ ID NO: 1563 - RNA, 22 nt, Artificial Sequence
  synthetic oligonucleotide
uggagagaaaggcaguuccuga

SEQ ID NO: 1564 - RNA, 20 nt, Artificial Sequence
  synthetic oligonucleotide
uggagagaaaggcaguuccu

SEQ ID NO: 1565 - RNA, 14 nt, Artificial Sequence
  synthetic oligonucleotide
ugccuuucucucca

SEQ ID NO: 1566 - RNA, 22 nt, Artificial Sequence
  synthetic oligonucleotide
aggggcuggcuuuccucugguc

SEQ ID NO: 1567 - RNA, 20 nt, Artificial Sequence
  synthetic oligonucleotide
aggggcuggcuuuccucugg

SEQ ID NO: 1568 - RNA, 14 nt, Artificial Sequence
  synthetic oligonucleotide
gaaagccagccccu

SEQ ID NO: 1569 - RNA, 22 nt, Artificial Sequence
  synthetic oligonucleotide
caaagaauucuccuuuugggcu

SEQ ID NO: 1570 - RNA, 20 nt, Artificial Sequence
  synthetic oligonucleotide
caaagaauucuccuuuuggg

SEQ ID NO: 1571 - RNA, 14 nt, Artificial Sequence
  synthetic oligonucleotide
aggagaauucuuug

SEQ ID NO: 1572 - RNA, 22 nt, Artificial Sequence
  synthetic oligonucleotide
gcccaaaggugaauuuuuuggg

SEQ ID NO: 1573 - RNA, 20 nt, Artificial Sequence
  synthetic oligonucleotide
gcccaaaggugaauuuuuug

SEQ ID NO: 1574 - RNA, 14 nt, Artificial Sequence
  synthetic oligonucleotide
auucaccuuugggc

SEQ ID NO: 1575 - RNA, 22 nt, Artificial Sequence
  synthetic oligonucleotide
ucgugucuuguguugcagccgg

SEQ ID NO: 1576 - RNA, 20 nt, Artificial Sequence
  synthetic oligonucleotide
ucgugucuuguguugcagcc

SEQ ID NO: 1577 - RNA, 14 nt, Artificial Sequence
  synthetic oligonucleotide
aacacaagacacga

SEQ ID NO: 1578 - RNA, 22 nt, Artificial Sequence
  synthetic oligonucleotide
ggcuacaacacaggacccgggc

SEQ ID NO: 1579 - RNA, 20 nt, Artificial Sequence
  synthetic oligonucleotide
ggcuacaacacaggacccgg

SEQ ID NO: 1580 - RNA, 14 nt, Artificial Sequence
  synthetic oligonucleotide
ccuguguuguagcc

SEQ ID NO: 1581 - RNA, 21 nt, Artificial Sequence
  synthetic oligonucleotide
cucccacaugcaggguuugca

SEQ ID NO: 1582 - RNA, 20 nt, Artificial Sequence
  synthetic oligonucleotide
cucccacaugcaggguuugc

SEQ ID NO: 1583 - RNA, 14 nt, Artificial Sequence
  synthetic oligonucleotide
ccugcaugugggag

SEQ ID NO: 1584 - RNA, 21 nt, Artificial Sequence
  synthetic oligonucleotide
caucccuugcaugguggaggg

SEQ ID NO: 1585 - RNA, 20 nt, Artificial Sequence
  synthetic oligonucleotide
caucccuugcaugguggagg

SEQ ID NO: 1586 - RNA, 14 nt, Artificial Sequence
  synthetic oligonucleotide
ccaugcaagggaug

SEQ ID NO: 1587 - RNA, 23 nt, Artificial Sequence
  synthetic oligonucleotide
uaaggugcaucuagugcagauag

SEQ ID NO: 1588 - RNA, 20 nt, Artificial Sequence
  synthetic oligonucleotide
uaaggugcaucuagugcaga

SEQ ID NO: 1589 - RNA, 14 nt, Artificial Sequence
  synthetic oligonucleotide
cuagaugcaccuua

SEQ ID NO: 1590 - RNA, 23 nt, Artificial Sequence
  synthetic oligonucleotide
acugcccuaagugcuccuucugg

SEQ ID NO: 1591 - RNA, 20 nt, Artificial Sequence
  synthetic oligonucleotide
acugcccuaagugcuccuuc

SEQ ID NO: 1592 - RNA, 14 nt, Artificial Sequence
  synthetic oligonucleotide
gcacuuagggcagu

SEQ ID NO: 1593 - RNA, 23 nt, Artificial Sequence
  synthetic oligonucleotide
uaaggugcaucuagugcaguuag

SEQ ID NO: 1594 - RNA, 20 nt, Artificial Sequence
  synthetic oligonucleotide
uaaggugcaucuagugcagu

SEQ ID NO: 1595 - RNA, 14 nt, Artificial Sequence
  synthetic oligonucleotide
cuagaugcaccuua

SEQ ID NO: 1596 - RNA, 22 nt, Artificial Sequence
  synthetic oligonucleotide
ugcccuaaaugccccuucuggc

SEQ ID NO: 1597 - RNA, 20 nt, Artificial Sequence
  synthetic oligonucleotide
ugcccuaaaugccccuucug

SEQ ID NO: 1598 - RNA, 14 nt, Artificial Sequence
  synthetic oligonucleotide
gggcauuuagggca

SEQ ID NO: 1599 - RNA, 22 nt, Artificial Sequence
  synthetic oligonucleotide
ugauauguuugauauauuaggu

SEQ ID NO: 1600 - RNA, 20 nt, Artificial Sequence
  synthetic oligonucleotide
ugauauguuugauauauuag

SEQ ID NO: 1601 - RNA, 14 nt, Artificial Sequence
  synthetic oligonucleotide
uaucaaacauauca

SEQ ID NO: 1602 - RNA, 21 nt, Artificial Sequence
  synthetic oligonucleotide
cggcggggacggcgauugguc

SEQ ID NO: 1603 - RNA, 20 nt, Artificial Sequence
  synthetic oligonucleotide
cggcggggacggcgauuggu

SEQ ID NO: 1604 - RNA, 14 nt, Artificial Sequence
  synthetic oligonucleotide
cgccguccccgccg

SEQ ID NO: 1605 - RNA, 22 nt, Artificial Sequence
  synthetic oligonucleotide
cgcaggggccgggugcucaccg

SEQ ID NO: 1606 - RNA, 20 nt, Artificial Sequence
  synthetic oligonucleotide
cgcaggggccgggugcucac

SEQ ID NO: 1607 - RNA, 14 nt, Artificial Sequence
  synthetic oligonucleotide
acccggccccugcg

SEQ ID NO: 1608 - RNA, 21 nt, Artificial Sequence
  synthetic oligonucleotide
ugagugccggugccugcccug

SEQ ID NO: 1609 - RNA, 20 nt, Artificial Sequence
  synthetic oligonucleotide
ugagugccggugccugcccu

SEQ ID NO: 1610 - RNA, 14 nt, Artificial Sequence
  synthetic oligonucleotide
ggcaccggcacuca

SEQ ID NO: 1611 - RNA, 21 nt, Artificial Sequence
  synthetic oligonucleotide
ugauauguuugauauuggguu

SEQ ID NO: 1612 - RNA, 20 nt, Artificial Sequence
  synthetic oligonucleotide
ugauauguuugauauugggu

SEQ ID NO: 1613 - RNA, 14 nt, Artificial Sequence
  synthetic oligonucleotide
uaucaaacauauca

SEQ ID NO: 1614 - RNA, 23 nt, Artificial Sequence
  synthetic oligonucleotide
caacggaaucccaaaagcagcug

SEQ ID NO: 1615 - RNA, 20 nt, Artificial Sequence
  synthetic oligonucleotide
caacggaaucccaaaagcag

SEQ ID NO: 1616 - RNA, 14 nt, Artificial Sequence
  synthetic oligonucleotide
uugggauuccguug

SEQ ID NO: 1617 - RNA, 22 nt, Artificial Sequence
  synthetic oligonucleotide
gcugcgcuuggauuucgucccc

SEQ ID NO: 1618 - RNA, 20 nt, Artificial Sequence
  synthetic oligonucleotide
gcugcgcuuggauuucgucc

SEQ ID NO: 1619 - RNA, 14 nt, Artificial Sequence
  synthetic oligonucleotide
aauccaagcgcagc

SEQ ID NO: 1620 - RNA, 21 nt, Artificial Sequence
  synthetic oligonucleotide
ccaguccugugccugccgccu

SEQ ID NO: 1621 - RNA, 20 nt, Artificial Sequence
  synthetic oligonucleotide
ccaguccugugccugccgcc

SEQ ID NO: 1622 - RNA, 14 nt, Artificial Sequence
  synthetic oligonucleotide
aggcacaggacugg

SEQ ID NO: 1623 - RNA, 23 nt, Artificial Sequence
  synthetic oligonucleotide
ugaguaccgccaugucuguuggg

SEQ ID NO: 1624 - RNA, 20 nt, Artificial Sequence
  synthetic oligonucleotide
ugaguaccgccaugucuguu

SEQ ID NO: 1625 - RNA, 14 nt, Artificial Sequence
  synthetic oligonucleotide
cauggcgguacuca

SEQ ID NO: 1626 - RNA, 20 nt, Artificial Sequence
  synthetic oligonucleotide
caccaggcauuguggucucc

SEQ ID NO: 1627 - RNA, 20 nt, Artificial Sequence
  synthetic oligonucleotide
caccaggcauuguggucucc

SEQ ID NO: 1628 - RNA, 14 nt, Artificial Sequence
  synthetic oligonucleotide
cacaaugccuggug

SEQ ID NO: 1629 - RNA, 22 nt, Artificial Sequence
  synthetic oligonucleotide
uacccagagcaugcagugugaa

SEQ ID NO: 1630 - RNA, 20 nt, Artificial Sequence
  synthetic oligonucleotide
uacccagagcaugcagugug

SEQ ID NO: 1631 - RNA, 14 nt, Artificial Sequence
  synthetic oligonucleotide
gcaugcucugggua

SEQ ID NO: 1632 - RNA, 22 nt, Artificial Sequence
  synthetic oligonucleotide
ucugcccccuccgcugcugcca

SEQ ID NO: 1633 - RNA, 20 nt, Artificial Sequence
  synthetic oligonucleotide
ucugcccccuccgcugcugc

SEQ ID NO: 1634 - RNA, 14 nt, Artificial Sequence
  synthetic oligonucleotide
gcggagggggcaga

SEQ ID NO: 1635 - RNA, 22 nt, Artificial Sequence
  synthetic oligonucleotide
cccugugcccggcccacuucug

SEQ ID NO: 1636 - RNA, 20 nt, Artificial Sequence
  synthetic oligonucleotide
cccugugcccggcccacuuc

SEQ ID NO: 1637 - RNA, 14 nt, Artificial Sequence
  synthetic oligonucleotide
ggccgggcacaggg

SEQ ID NO: 1638 - RNA, 22 nt, Artificial Sequence
  synthetic oligonucleotide
ggaggggucccgcacugggagg

SEQ ID NO: 1639 - RNA, 20 nt, Artificial Sequence
  synthetic oligonucleotide
ggaggggucccgcacuggga

SEQ ID NO: 1640 - RNA, 14 nt, Artificial Sequence
  synthetic oligonucleotide
ugcgggaccccucc

SEQ ID NO: 1641 - RNA, 20 nt, Artificial Sequence
  synthetic oligonucleotide
ccccagggcgacgcggcggg

SEQ ID NO: 1642 - RNA, 20 nt, Artificial Sequence
  synthetic oligonucleotide
ccccagggcgacgcggcggg

SEQ ID NO: 1643 - RNA, 14 nt, Artificial Sequence
  synthetic oligonucleotide
gcgucgcccugggg

SEQ ID NO: 1644 - RNA, 22 nt, Artificial Sequence
  synthetic oligonucleotide
accuugccuugcugcccgggcc

SEQ ID NO: 1645 - RNA, 20 nt, Artificial Sequence
  synthetic oligonucleotide
accuugccuugcugcccggg

SEQ ID NO: 1646 - RNA, 14 nt, Artificial Sequence
  synthetic oligonucleotide
cagcaaggcaaggu

SEQ ID NO: 1647 - RNA, 21 nt, Artificial Sequence
  synthetic oligonucleotide
cugaccuaugaauugacagcc

SEQ ID NO: 1648 - RNA, 20 nt, Artificial Sequence
  synthetic oligonucleotide
cugaccuaugaauugacagc

SEQ ID NO: 1649 - RNA, 14 nt, Artificial Sequence
  synthetic oligonucleotide
aauucauaggucag

SEQ ID NO: 1650 - RNA, 22 nt, Artificial Sequence
  synthetic oligonucleotide
cugccaauuccauaggucacag

SEQ ID NO: 1651 - RNA, 20 nt, Artificial Sequence
  synthetic oligonucleotide
cugccaauuccauaggucac

SEQ ID NO: 1652 - RNA, 14 nt, Artificial Sequence
  synthetic oligonucleotide
uauggaauuggcag

SEQ ID NO: 1653 - RNA, 22 nt, Artificial Sequence
  synthetic oligonucleotide
aacuggccuacaaagucccagu

SEQ ID NO: 1654 - RNA, 20 nt, Artificial Sequence
  synthetic oligonucleotide
aacuggccuacaaaguccca

SEQ ID NO: 1655 - RNA, 14 nt, Artificial Sequence
  synthetic oligonucleotide
uuuguaggccaguu

SEQ ID NO: 1656 - RNA, 22 nt, Artificial Sequence
  synthetic oligonucleotide
ugggucuuugcgggcgagauga

SEQ ID NO: 1657 - RNA, 20 nt, Artificial Sequence
  synthetic oligonucleotide
ugggucuuugcgggcgagau

SEQ ID NO: 1658 - RNA, 14 nt, Artificial Sequence
  synthetic oligonucleotide
cccgcaaagaccca

SEQ ID NO: 1659 - RNA, 22 nt, Artificial Sequence
  synthetic oligonucleotide
aacuggcccucaaagucccgcu

SEQ ID NO: 1660 - RNA, 20 nt, Artificial Sequence
  synthetic oligonucleotide
aacuggcccucaaagucccg

SEQ ID NO: 1661 - RNA, 14 nt, Artificial Sequence
  synthetic oligonucleotide
uuugagggccaguu

SEQ ID NO: 1662 - RNA, 22 nt, Artificial Sequence
  synthetic oligonucleotide
cgggguuuugagggcgagauga

SEQ ID NO: 1663 - RNA, 20 nt, Artificial Sequence
  synthetic oligonucleotide
cgggguuuugagggcgagau

SEQ ID NO: 1664 - RNA, 14 nt, Artificial Sequence
  synthetic oligonucleotide
cccucaaaaccccg

SEQ ID NO: 1665 - RNA, 22 nt, Artificial Sequence
  synthetic oligonucleotide
uguaacagcaacuccaugugga

SEQ ID NO: 1666 - RNA, 20 nt, Artificial Sequence
  synthetic oligonucleotide
uguaacagcaacuccaugug

SEQ ID NO: 1667 - RNA, 14 nt, Artificial Sequence
  synthetic oligonucleotide
gaguugcuguuaca

SEQ ID NO: 1668 - RNA, 22 nt, Artificial Sequence
  synthetic oligonucleotide
ccaguggggcugcuguuaucug

SEQ ID NO: 1669 - RNA, 20 nt, Artificial Sequence
  synthetic oligonucleotide
ccaguggggcugcuguuauc

SEQ ID NO: 1670 - RNA, 14 nt, Artificial Sequence
  synthetic oligonucleotide
agcagccccacugg

SEQ ID NO: 1671 - RNA, 21 nt, Artificial Sequence
  synthetic oligonucleotide
uagcagcacagaaauauuggc

SEQ ID NO: 1672 - RNA, 20 nt, Artificial Sequence
  synthetic oligonucleotide
uagcagcacagaaauauugg

SEQ ID NO: 1673 - RNA, 14 nt, Artificial Sequence
  synthetic oligonucleotide
uuucugugcugcua

SEQ ID NO: 1674 - RNA, 22 nt, Artificial Sequence
  synthetic oligonucleotide
ccaauauuggcugugcugcucc

SEQ ID NO: 1675 - RNA, 20 nt, Artificial Sequence
  synthetic oligonucleotide
ccaauauuggcugugcugcu

SEQ ID NO: 1676 - RNA, 14 nt, Artificial Sequence
  synthetic oligonucleotide
acagccaauauugg

SEQ ID NO: 1677 - RNA, 22 nt, Artificial Sequence
  synthetic oligonucleotide
uagguaguuucauguuguuggg

SEQ ID NO: 1678 - RNA, 20 nt, Artificial Sequence
  synthetic oligonucleotide
uagguaguuucauguuguug

SEQ ID NO: 1679 - RNA, 14 nt, Artificial Sequence
  synthetic oligonucleotide
caugaaacuaccua

SEQ ID NO: 1680 - RNA, 22 nt, Artificial Sequence
  synthetic oligonucleotide
cggcaacaagaaacugccugag

SEQ ID NO: 1681 - RNA, 20 nt, Artificial Sequence
  synthetic oligonucleotide
cggcaacaagaaacugccug

SEQ ID NO: 1682 - RNA, 14 nt, Artificial Sequence
  synthetic oligonucleotide
guuucuuguugccg

SEQ ID NO: 1683 - RNA, 22 nt, Artificial Sequence
  synthetic oligonucleotide
uagguaguuuccuguuguuggg

SEQ ID NO: 1684 - RNA, 20 nt, Artificial Sequence
  synthetic oligonucleotide
uagguaguuuccuguuguug

SEQ ID NO: 1685 - RNA, 14 nt, Artificial Sequence
  synthetic oligonucleotide
caggaaacuaccua

SEQ ID NO: 1686 - RNA, 22 nt, Artificial Sequence
  synthetic oligonucleotide
ucgacagcacgacacugccuuc

SEQ ID NO: 1687 - RNA, 20 nt, Artificial Sequence
  synthetic oligonucleotide
ucgacagcacgacacugccu

SEQ ID NO: 1688 - RNA, 14 nt, Artificial Sequence
  synthetic oligonucleotide
ugucgugcugucga

SEQ ID NO: 1689 - RNA, 22 nt, Artificial Sequence
  synthetic oligonucleotide
uucaccaccuucuccacccagc

SEQ ID NO: 1690 - RNA, 20 nt, Artificial Sequence
  synthetic oligonucleotide
uucaccaccuucuccaccca

SEQ ID NO: 1691 - RNA, 14 nt, Artificial Sequence
  synthetic oligonucleotide
gagaagguggugaa

SEQ ID NO: 1692 - RNA, 22 nt, Artificial Sequence
  synthetic oligonucleotide
ucaggccaggcacaguggcuca

SEQ ID NO: 1693 - RNA, 20 nt, Artificial Sequence
  synthetic oligonucleotide
ucaggccaggcacaguggcu

SEQ ID NO: 1694 - RNA, 14 nt, Artificial Sequence
  synthetic oligonucleotide
ugugccuggccuga

SEQ ID NO: 1695 - RNA, 19 nt, Artificial Sequence
  synthetic oligonucleotide
accgugcaaagguagcaua

SEQ ID NO: 1696 - RNA, 19 nt, Artificial Sequence
  synthetic oligonucleotide
accgugcaaagguagcaua

SEQ ID NO: 1697 - RNA, 14 nt, Artificial Sequence
  synthetic oligonucleotide
uaccuuugcacggu

SEQ ID NO: 1698 - RNA, 20 nt, Artificial Sequence
  synthetic oligonucleotide
ccuccugcccuccuugcugu

SEQ ID NO: 1699 - RNA, 20 nt, Artificial Sequence
  synthetic oligonucleotide
ccuccugcccuccuugcugu

SEQ ID NO: 1700 - RNA, 14 nt, Artificial Sequence
  synthetic oligonucleotide
aggagggcaggagg

SEQ ID NO: 1701 - RNA, 22 nt, Artificial Sequence
  synthetic oligonucleotide
gguccagaggggagauagguuc

SEQ ID NO: 1702 - RNA, 20 nt, Artificial Sequence
  synthetic oligonucleotide
gguccagaggggagauaggu

SEQ ID NO: 1703 - RNA, 14 nt, Artificial Sequence
  synthetic oligonucleotide
cuccccucuggacc

SEQ ID NO: 1704 - RNA, 22 nt, Artificial Sequence
  synthetic oligonucleotide
acaguagucugcacauugguua

SEQ ID NO: 1705 - RNA, 20 nt, Artificial Sequence
  synthetic oligonucleotide
acaguagucugcacauuggu

SEQ ID NO: 1706 - RNA, 14 nt, Artificial Sequence
  synthetic oligonucleotide
gugcagacuacugu

SEQ ID NO: 1707 - RNA, 23 nt, Artificial Sequence
  synthetic oligonucleotide
cccaguguucagacuaccuguuc

SEQ ID NO: 1708 - RNA, 20 nt, Artificial Sequence
  synthetic oligonucleotide
cccaguguucagacuaccug

SEQ ID NO: 1709 - RNA, 14 nt, Artificial Sequence
  synthetic oligonucleotide
gucugaacacuggg

SEQ ID NO: 1710 - RNA, 22 nt, Artificial Sequence
  synthetic oligonucleotide
acaguagucugcacauugguua

SEQ ID NO: 1711 - RNA, 20 nt, Artificial Sequence
  synthetic oligonucleotide
acaguagucugcacauuggu

SEQ ID NO: 1712 - RNA, 14 nt, Artificial Sequence
  synthetic oligonucleotide
gugcagacuacugu

SEQ ID NO: 1713 - RNA, 23 nt, Artificial Sequence
  synthetic oligonucleotide
cccaguguuuagacuaucuguuc

SEQ ID NO: 1714 - RNA, 20 nt, Artificial Sequence
  synthetic oligonucleotide
cccaguguuuagacuaucug

SEQ ID NO: 1715 - RNA, 14 nt, Artificial Sequence
  synthetic oligonucleotide
gucuaaacacuggg

SEQ ID NO: 1716 - RNA, 23 nt, Artificial Sequence
  synthetic oligonucleotide
ugugcaaaucuaugcaaaacuga

SEQ ID NO: 1717 - RNA, 20 nt, Artificial Sequence
  synthetic oligonucleotide
ugugcaaaucuaugcaaaac

SEQ ID NO: 1718 - RNA, 14 nt, Artificial Sequence
  synthetic oligonucleotide
cauagauuugcaca

SEQ ID NO: 1719 - RNA, 22 nt, Artificial Sequence
  synthetic oligonucleotide
aguuuugcauaguugcacuaca

SEQ ID NO: 1720 - RNA, 20 nt, Artificial Sequence
  synthetic oligonucleotide
aguuuugcauaguugcacua

SEQ ID NO: 1721 - RNA, 14 nt, Artificial Sequence
  synthetic oligonucleotide
aacuaugcaaaacu

SEQ ID NO: 1722 - RNA, 23 nt, Artificial Sequence
  synthetic oligonucleotide
ugugcaaauccaugcaaaacuga

SEQ ID NO: 1723 - RNA, 20 nt, Artificial Sequence
  synthetic oligonucleotide
ugugcaaauccaugcaaaac

SEQ ID NO: 1724 - RNA, 14 nt, Artificial Sequence
  synthetic oligonucleotide
cauggauuugcaca

SEQ ID NO: 1725 - RNA, 23 nt, Artificial Sequence
  synthetic oligonucleotide
aguuuugcagguuugcauccagc

SEQ ID NO: 1726 - RNA, 20 nt, Artificial Sequence
  synthetic oligonucleotide
aguuuugcagguuugcaucc

SEQ ID NO: 1727 - RNA, 14 nt, Artificial Sequence
  synthetic oligonucleotide
aaaccugcaaaacu

SEQ ID NO: 1728 - RNA, 22 nt, Artificial Sequence
  synthetic oligonucleotide
aguuuugcagguuugcauuuca

SEQ ID NO: 1729 - RNA, 20 nt, Artificial Sequence
  synthetic oligonucleotide
aguuuugcagguuugcauuu

SEQ ID NO: 1730 - RNA, 14 nt, Artificial Sequence
  synthetic oligonucleotide
aaaccugcaaaacu

SEQ ID NO: 1731 - RNA, 22 nt, Artificial Sequence
  synthetic oligonucleotide
uaacacugucugguaacgaugu

SEQ ID NO: 1732 - RNA, 20 nt, Artificial Sequence
  synthetic oligonucleotide
uaacacugucugguaacgau

SEQ ID NO: 1733 - RNA, 14 nt, Artificial Sequence
  synthetic oligonucleotide
accagacaguguua

SEQ ID NO: 1734 - RNA, 22 nt, Artificial Sequence
  synthetic oligonucleotide
caucuuaccggacagugcugga

SEQ ID NO: 1735 - RNA, 20 nt, Artificial Sequence
  synthetic oligonucleotide
caucuuaccggacagugcug

SEQ ID NO: 1736 - RNA, 14 nt, Artificial Sequence
  synthetic oligonucleotide
uguccgguaagaug

SEQ ID NO: 1737 - RNA, 22 nt, Artificial Sequence
  synthetic oligonucleotide
uaauacugccugguaaugauga

SEQ ID NO: 1738 - RNA, 20 nt, Artificial Sequence
  synthetic oligonucleotide
uaauacugccugguaaugau

SEQ ID NO: 1739 - RNA, 14 nt, Artificial Sequence
  synthetic oligonucleotide
accaggcaguauua

SEQ ID NO: 1740 - RNA, 22 nt, Artificial Sequence
  synthetic oligonucleotide
caucuuacugggcagcauugga

SEQ ID NO: 1741 - RNA, 20 nt, Artificial Sequence
  synthetic oligonucleotide
caucuuacugggcagcauug

SEQ ID NO: 1742 - RNA, 14 nt, Artificial Sequence
  synthetic oligonucleotide
ugcccaguaagaug

SEQ ID NO: 1743 - RNA, 23 nt, Artificial Sequence
  synthetic oligonucleotide
uaauacugccggguaaugaugga

SEQ ID NO: 1744 - RNA, 20 nt, Artificial Sequence
  synthetic oligonucleotide
uaauacugccggguaaugau

SEQ ID NO: 1745 - RNA, 14 nt, Artificial Sequence
  synthetic oligonucleotide
acccggcaguauua

SEQ ID NO: 1746 - RNA, 22 nt, Artificial Sequence
  synthetic oligonucleotide
cgucuuacccagcaguguuugg

SEQ ID NO: 1747 - RNA, 20 nt, Artificial Sequence
  synthetic oligonucleotide
cgucuuacccagcaguguuu

SEQ ID NO: 1748 - RNA, 14 nt, Artificial Sequence
  synthetic oligonucleotide
ugcuggguaagacg

SEQ ID NO: 1749 - RNA, 20 nt, Artificial Sequence
  synthetic oligonucleotide
agagguauagggcaugggaa

SEQ ID NO: 1750 - RNA, 20 nt, Artificial Sequence
  synthetic oligonucleotide
agagguauagggcaugggaa

SEQ ID NO: 1751 - RNA, 14 nt, Artificial Sequence
  synthetic oligonucleotide
ugcccuauaccucu

SEQ ID NO: 1752 - RNA, 22 nt, Artificial Sequence
  synthetic oligonucleotide
uuccuaugcauauacuucuuug

SEQ ID NO: 1753 - RNA, 20 nt, Artificial Sequence
  synthetic oligonucleotide
uuccuaugcauauacuucuu

SEQ ID NO: 1754 - RNA, 14 nt, Artificial Sequence
  synthetic oligonucleotide
uauaugcauaggaa

SEQ ID NO: 1755 - RNA, 22 nt, Artificial Sequence
  synthetic oligonucleotide
gugaaauguuuaggaccacuag

SEQ ID NO: 1756 - RNA, 20 nt, Artificial Sequence
  synthetic oligonucleotide
gugaaauguuuaggaccacu

SEQ ID NO: 1757 - RNA, 14 nt, Artificial Sequence
  synthetic oligonucleotide
ccuaaacauuucac

SEQ ID NO: 1758 - RNA, 22 nt, Artificial Sequence
  synthetic oligonucleotide
uucccuuugucauccuaugccu

SEQ ID NO: 1759 - RNA, 20 nt, Artificial Sequence
  synthetic oligonucleotide
uucccuuugucauccuaugc

SEQ ID NO: 1760 - RNA, 14 nt, Artificial Sequence
  synthetic oligonucleotide
gaugacaaagggaa

SEQ ID NO: 1761 - RNA, 22 nt, Artificial Sequence
  synthetic oligonucleotide
uccuucauuccaccggagucug

SEQ ID NO: 1762 - RNA, 20 nt, Artificial Sequence
  synthetic oligonucleotide
uccuucauuccaccggaguc

SEQ ID NO: 1763 - RNA, 14 nt, Artificial Sequence
  synthetic oligonucleotide
gguggaaugaagga

SEQ ID NO: 1764 - RNA, 21 nt, Artificial Sequence
  synthetic oligonucleotide
gauuucaguggagugaaguuc

SEQ ID NO: 1765 - RNA, 20 nt, Artificial Sequence
  synthetic oligonucleotide
gauuucaguggagugaaguu

SEQ ID NO: 1766 - RNA, 14 nt, Artificial Sequence
  synthetic oligonucleotide
acuccacugaaauc

SEQ ID NO: 1767 - RNA, 20 nt, Artificial Sequence
  synthetic oligonucleotide
uguuuugauaacaguaaugu

SEQ ID NO: 1768 - RNA, 20 nt, Artificial Sequence
  synthetic oligonucleotide
uguuuugauaacaguaaugu

SEQ ID NO: 1769 - RNA, 14 nt, Artificial Sequence
  synthetic oligonucleotide
cuguuaucaaaaca

SEQ ID NO: 1770 - RNA, 23 nt, Artificial Sequence
  synthetic oligonucleotide
guguuaauuaaaccucuauuuac

SEQ ID NO: 1771 - RNA, 20 nt, Artificial Sequence
  synthetic oligonucleotide
guguuaauuaaaccucuauu

SEQ ID NO: 1772 - RNA, 14 nt, Artificial Sequence
  synthetic oligonucleotide
gguuuaauuaacac

SEQ ID NO: 1773 - RNA, 23 nt, Artificial Sequence
  synthetic oligonucleotide
cuguaauauaaauuuaauuuauu

SEQ ID NO: 1774 - RNA, 20 nt, Artificial Sequence
  synthetic oligonucleotide
cuguaauauaaauuuaauuu

SEQ ID NO: 1775 - RNA, 14 nt, Artificial Sequence
  synthetic oligonucleotide
aauuuauauuacag

SEQ ID NO: 1776 - RNA, 22 nt, Artificial Sequence
  synthetic oligonucleotide
uggaauguaaggaagugugugg

SEQ ID NO: 1777 - RNA, 20 nt, Artificial Sequence
  synthetic oligonucleotide
uggaauguaaggaagugugu

SEQ ID NO: 1778 - RNA, 14 nt, Artificial Sequence
  synthetic oligonucleotide
uuccuuacauucca

SEQ ID NO: 1779 - RNA, 22 nt, Artificial Sequence
  synthetic oligonucleotide
auaagacgagcaaaaagcuugu

SEQ ID NO: 1780 - RNA, 20 nt, Artificial Sequence
  synthetic oligonucleotide
auaagacgagcaaaaagcuu

SEQ ID NO: 1781 - RNA, 14 nt, Artificial Sequence
  synthetic oligonucleotide
uuugcucgucuuau

SEQ ID NO: 1782 - RNA, 22 nt, Artificial Sequence
  synthetic oligonucleotide
auaagacgaacaaaagguuugu

SEQ ID NO: 1783 - RNA, 20 nt, Artificial Sequence
  synthetic oligonucleotide
auaagacgaacaaaagguuu

SEQ ID NO: 1784 - RNA, 14 nt, Artificial Sequence
  synthetic oligonucleotide
uuuguucgucuuau

SEQ ID NO: 1785 - RNA, 23 nt, Artificial Sequence
  synthetic oligonucleotide
uaaagugcuuauagugcagguag

SEQ ID NO: 1786 - RNA, 20 nt, Artificial Sequence
  synthetic oligonucleotide
uaaagugcuuauagugcagg

SEQ ID NO: 1787 - RNA, 14 nt, Artificial Sequence
  synthetic oligonucleotide
cuauaagcacuuua

SEQ ID NO: 1788 - RNA, 22 nt, Artificial Sequence
  synthetic oligonucleotide
acugcauuaugagcacuuaaag

SEQ ID NO: 1789 - RNA, 20 nt, Artificial Sequence
  synthetic oligonucleotide
acugcauuaugagcacuuaa

SEQ ID NO: 1790 - RNA, 14 nt, Artificial Sequence
  synthetic oligonucleotide
gcucauaaugcagu

SEQ ID NO: 1791 - RNA, 23 nt, Artificial Sequence
  synthetic oligonucleotide
caaagugcucauagugcagguag

SEQ ID NO: 1792 - RNA, 20 nt, Artificial Sequence
  synthetic oligonucleotide
caaagugcucauagugcagg

SEQ ID NO: 1793 - RNA, 14 nt, Artificial Sequence
  synthetic oligonucleotide
cuaugagcacuuug

SEQ ID NO: 1794 - RNA, 22 nt, Artificial Sequence
  synthetic oligonucleotide
acuguaguaugggcacuuccag

SEQ ID NO: 1795 - RNA, 20 nt, Artificial Sequence
  synthetic oligonucleotide
acuguaguaugggcacuucc

SEQ ID NO: 1796 - RNA, 14 nt, Artificial Sequence
  synthetic oligonucleotide
gcccauacuacagu

SEQ ID NO: 1797 - RNA, 22 nt, Artificial Sequence
  synthetic oligonucleotide
uagcuuaucagacugauguuga

SEQ ID NO: 1798 - RNA, 20 nt, Artificial Sequence
  synthetic oligonucleotide
uagcuuaucagacugauguu

SEQ ID NO: 1799 - RNA, 14 nt, Artificial Sequence
  synthetic oligonucleotide
agucugauaagcua

SEQ ID NO: 1800 - RNA, 21 nt, Artificial Sequence
  synthetic oligonucleotide
caacaccagucgaugggcugu

SEQ ID NO: 1801 - RNA, 20 nt, Artificial Sequence
  synthetic oligonucleotide
caacaccagucgaugggcug

SEQ ID NO: 1802 - RNA, 14 nt, Artificial Sequence
  synthetic oligonucleotide
aucgacugguguug

SEQ ID NO: 1803 - RNA, 22 nt, Artificial Sequence
  synthetic oligonucleotide
cugugcgugugacagcggcuga

SEQ ID NO: 1804 - RNA, 20 nt, Artificial Sequence
  synthetic oligonucleotide
cugugcgugugacagcggcu

SEQ ID NO: 1805 - RNA, 14 nt, Artificial Sequence
  synthetic oligonucleotide
ugucacacgcacag

SEQ ID NO: 1806 - RNA, 22 nt, Artificial Sequence
  synthetic oligonucleotide
uucccuuugucauccuucgccu

SEQ ID NO: 1807 - RNA, 20 nt, Artificial Sequence
  synthetic oligonucleotide
uucccuuugucauccuucgc

SEQ ID NO: 1808 - RNA, 14 nt, Artificial Sequence
  synthetic oligonucleotide
gaugacaaagggaa

SEQ ID NO: 1809 - RNA, 22 nt, Artificial Sequence
  synthetic oligonucleotide
uuggggaaacggccgcugagug

SEQ ID NO: 1810 - RNA, 20 nt, Artificial Sequence
  synthetic oligonucleotide
uuggggaaacggccgcugag

SEQ ID NO: 1811 - RNA, 14 nt, Artificial Sequence
  synthetic oligonucleotide
ggccguuuccccaa

SEQ ID NO: 1812 - RNA, 21 nt, Artificial Sequence
  synthetic oligonucleotide
auuugugcuuggcucugucac

SEQ ID NO: 1813 - RNA, 20 nt, Artificial Sequence
  synthetic oligonucleotide
auuugugcuuggcucuguca

SEQ ID NO: 1814 - RNA, 14 nt, Artificial Sequence
  synthetic oligonucleotide
agccaagcacaaau

SEQ ID NO: 1815 - RNA, 22 nt, Artificial Sequence
  synthetic oligonucleotide
uagucccuuccuugaagcgguc

SEQ ID NO: 1816 - RNA, 20 nt, Artificial Sequence
  synthetic oligonucleotide
uagucccuuccuugaagcgg

SEQ ID NO: 1817 - RNA, 14 nt, Artificial Sequence
  synthetic oligonucleotide
caaggaagggacua

SEQ ID NO: 1818 - RNA, 21 nt, Artificial Sequence
  synthetic oligonucleotide
cgagccucaagcaagggacuu

SEQ ID NO: 1819 - RNA, 20 nt, Artificial Sequence
  synthetic oligonucleotide
cgagccucaagcaagggacu

SEQ ID NO: 1820 - RNA, 14 nt, Artificial Sequence
  synthetic oligonucleotide
uugcuugaggcucg

SEQ ID NO: 1821 - RNA, 22 nt, Artificial Sequence
  synthetic oligonucleotide
agcuuccaugacuccugaugga

SEQ ID NO: 1822 - RNA, 20 nt, Artificial Sequence
  synthetic oligonucleotide
agcuuccaugacuccugaug

SEQ ID NO: 1823 - RNA, 14 nt, Artificial Sequence
  synthetic oligonucleotide
gagucauggaagcu

SEQ ID NO: 1824 - RNA, 22 nt, Artificial Sequence
  synthetic oligonucleotide
caucagaauucauggaggcuag

SEQ ID NO: 1825 - RNA, 20 nt, Artificial Sequence
  synthetic oligonucleotide
caucagaauucauggaggcu

SEQ ID NO: 1826 - RNA, 14 nt, Artificial Sequence
  synthetic oligonucleotide
caugaauucugaug

SEQ ID NO: 1827 - RNA, 21 nt, Artificial Sequence
  synthetic oligonucleotide
gguucuuagcauaggaggucu

SEQ ID NO: 1828 - RNA, 20 nt, Artificial Sequence
  synthetic oligonucleotide
gguucuuagcauaggagguc

SEQ ID NO: 1829 - RNA, 14 nt, Artificial Sequence
  synthetic oligonucleotide
cuaugcuaagaacc

SEQ ID NO: 1830 - RNA, 21 nt, Artificial Sequence
  synthetic oligonucleotide
ccucccaugccaagaacuccc

SEQ ID NO: 1831 - RNA, 20 nt, Artificial Sequence
  synthetic oligonucleotide
ccucccaugccaagaacucc

SEQ ID NO: 1832 - RNA, 14 nt, Artificial Sequence
  synthetic oligonucleotide
cuuggcaugggagg

SEQ ID NO: 1833 - RNA, 21 nt, Artificial Sequence
  synthetic oligonucleotide
uguucucuuugccaaggacag

SEQ ID NO: 1834 - RNA, 20 nt, Artificial Sequence
  synthetic oligonucleotide
uguucucuuugccaaggaca

SEQ ID NO: 1835 - RNA, 14 nt, Artificial Sequence
  synthetic oligonucleotide
uggcaaagagaaca

SEQ ID NO: 1836 - RNA, 21 nt, Artificial Sequence
  synthetic oligonucleotide
uaacagucuccagucacggcc

SEQ ID NO: 1837 - RNA, 20 nt, Artificial Sequence
  synthetic oligonucleotide
uaacagucuccagucacggc

SEQ ID NO: 1838 - RNA, 14 nt, Artificial Sequence
  synthetic oligonucleotide
acuggagacuguua

SEQ ID NO: 1839 - RNA, 22 nt, Artificial Sequence
  synthetic oligonucleotide
acagcaggcacagacaggcagu

SEQ ID NO: 1840 - RNA, 20 nt, Artificial Sequence
  synthetic oligonucleotide
acagcaggcacagacaggca

SEQ ID NO: 1841 - RNA, 14 nt, Artificial Sequence
  synthetic oligonucleotide
ucugugccugcugu

SEQ ID NO: 1842 - RNA, 22 nt, Artificial Sequence
  synthetic oligonucleotide
ugccugucuacacuugcugugc

SEQ ID NO: 1843 - RNA, 20 nt, Artificial Sequence
  synthetic oligonucleotide
ugccugucuacacuugcugu

SEQ ID NO: 1844 - RNA, 14 nt, Artificial Sequence
  synthetic oligonucleotide
aguguagacaggca

SEQ ID NO: 1845 - RNA, 21 nt, Artificial Sequence
  synthetic oligonucleotide
augaccuaugaauugacagac

SEQ ID NO: 1846 - RNA, 20 nt, Artificial Sequence
  synthetic oligonucleotide
augaccuaugaauugacaga

SEQ ID NO: 1847 - RNA, 14 nt, Artificial Sequence
  synthetic oligonucleotide
aauucauaggucau

SEQ ID NO: 1848 - RNA, 22 nt, Artificial Sequence
  synthetic oligonucleotide
uaaucucagcuggcaacuguga

SEQ ID NO: 1849 - RNA, 20 nt, Artificial Sequence
  synthetic oligonucleotide
uaaucucagcuggcaacugu

SEQ ID NO: 1850 - RNA, 14 nt, Artificial Sequence
  synthetic oligonucleotide
gccagcugagauua

SEQ ID NO: 1851 - RNA, 22 nt, Artificial Sequence
  synthetic oligonucleotide
aaaucucugcaggcaaauguga

SEQ ID NO: 1852 - RNA, 20 nt, Artificial Sequence
  synthetic oligonucleotide
aaaucucugcaggcaaaugu

SEQ ID NO: 1853 - RNA, 14 nt, Artificial Sequence
  synthetic oligonucleotide
gccugcagagauuu

SEQ ID NO: 1854 - RNA, 23 nt, Artificial Sequence
  synthetic oligonucleotide
uacugcaucaggaacugauugga

SEQ ID NO: 1855 - RNA, 20 nt, Artificial Sequence
  synthetic oligonucleotide
uacugcaucaggaacugauu

SEQ ID NO: 1856 - RNA, 14 nt, Artificial Sequence
  synthetic oligonucleotide
uuccugaugcagua

SEQ ID NO: 1857 - RNA, 21 nt, Artificial Sequence
  synthetic oligonucleotide
uugugcuugaucuaaccaugu

SEQ ID NO: 1858 - RNA, 20 nt, Artificial Sequence
  synthetic oligonucleotide
uugugcuugaucuaaccaug

SEQ ID NO: 1859 - RNA, 14 nt, Artificial Sequence
  synthetic oligonucleotide
uagaucaagcacaa

SEQ ID NO: 1860 - RNA, 22 nt, Artificial Sequence
  synthetic oligonucleotide
augguuccgucaagcaccaugg

SEQ ID NO: 1861 - RNA, 20 nt, Artificial Sequence
  synthetic oligonucleotide
augguuccgucaagcaccau

SEQ ID NO: 1862 - RNA, 14 nt, Artificial Sequence
  synthetic oligonucleotide
cuugacggaaccau

SEQ ID NO: 1863 - RNA, 22 nt, Artificial Sequence
  synthetic oligonucleotide
caugguucugucaagcaccgcg

SEQ ID NO: 1864 - RNA, 20 nt, Artificial Sequence
  synthetic oligonucleotide
caugguucugucaagcaccg

SEQ ID NO: 1865 - RNA, 14 nt, Artificial Sequence
  synthetic oligonucleotide
uugacagaaccaug

SEQ ID NO: 1866 - RNA, 22 nt, Artificial Sequence
  synthetic oligonucleotide
agaguugagucuggacgucccg

SEQ ID NO: 1867 - RNA, 20 nt, Artificial Sequence
  synthetic oligonucleotide
agaguugagucuggacgucc

SEQ ID NO: 1868 - RNA, 14 nt, Artificial Sequence
  synthetic oligonucleotide
ccagacucaacucu

SEQ ID NO: 1869 - RNA, 22 nt, Artificial Sequence
  synthetic oligonucleotide
agaauuguggcuggacaucugu

SEQ ID NO: 1870 - RNA, 20 nt, Artificial Sequence
  synthetic oligonucleotide
agaauuguggcuggacaucu

SEQ ID NO: 1871 - RNA, 14 nt, Artificial Sequence
  synthetic oligonucleotide
ccagccacaauucu

SEQ ID NO: 1872 - RNA, 21 nt, Artificial Sequence
  synthetic oligonucleotide
ugauuguccaaacgcaauucu

SEQ ID NO: 1873 - RNA, 20 nt, Artificial Sequence
  synthetic oligonucleotide
ugauuguccaaacgcaauuc

SEQ ID NO: 1874 - RNA, 14 nt, Artificial Sequence
  synthetic oligonucleotide
cguuuggacaauca

SEQ ID NO: 1875 - RNA, 22 nt, Artificial Sequence
  synthetic oligonucleotide
aagcugccaguugaagaacugu

SEQ ID NO: 1876 - RNA, 20 nt, Artificial Sequence
  synthetic oligonucleotide
aagcugccaguugaagaacu

SEQ ID NO: 1877 - RNA, 14 nt, Artificial Sequence
  synthetic oligonucleotide
ucaacuggcagcuu

SEQ ID NO: 1878 - RNA, 22 nt, Artificial Sequence
  synthetic oligonucleotide
aguucuucaguggcaagcuuua

SEQ ID NO: 1879 - RNA, 20 nt, Artificial Sequence
  synthetic oligonucleotide
aguucuucaguggcaagcuu

SEQ ID NO: 1880 - RNA, 14 nt, Artificial Sequence
  synthetic oligonucleotide
gccacugaagaacu

SEQ ID NO: 1881 - RNA, 23 nt, Artificial Sequence
  synthetic oligonucleotide
agcuacauugucugcuggguuuc

SEQ ID NO: 1882 - RNA, 20 nt, Artificial Sequence
  synthetic oligonucleotide
agcuacauugucugcugggu

SEQ ID NO: 1883 - RNA, 14 nt, Artificial Sequence
  synthetic oligonucleotide
cagacaauguagcu

SEQ ID NO: 1884 - RNA, 22 nt, Artificial Sequence
  synthetic oligonucleotide
accuggcauacaauguagauuu

SEQ ID NO: 1885 - RNA, 20 nt, Artificial Sequence
  synthetic oligonucleotide
accuggcauacaauguagau

SEQ ID NO: 1886 - RNA, 14 nt, Artificial Sequence
  synthetic oligonucleotide
auuguaugccaggu

SEQ ID NO: 1887 - RNA, 21 nt, Artificial Sequence
  synthetic oligonucleotide
agcuacaucuggcuacugggu

SEQ ID NO: 1888 - RNA, 20 nt, Artificial Sequence
  synthetic oligonucleotide
agcuacaucuggcuacuggg

SEQ ID NO: 1889 - RNA, 14 nt, Artificial Sequence
  synthetic oligonucleotide
agccagauguagcu

SEQ ID NO: 1890 - RNA, 22 nt, Artificial Sequence
  synthetic oligonucleotide
cucaguagccaguguagauccu

SEQ ID NO: 1891 - RNA, 20 nt, Artificial Sequence
  synthetic oligonucleotide
cucaguagccaguguagauc

SEQ ID NO: 1892 - RNA, 14 nt, Artificial Sequence
  synthetic oligonucleotide
cacuggcuacugag

SEQ ID NO: 1893 - RNA, 22 nt, Artificial Sequence
  synthetic oligonucleotide
ugucaguuugucaaauacccca

SEQ ID NO: 1894 - RNA, 20 nt, Artificial Sequence
  synthetic oligonucleotide
ugucaguuugucaaauaccc

SEQ ID NO: 1895 - RNA, 14 nt, Artificial Sequence
  synthetic oligonucleotide
uugacaaacugaca

SEQ ID NO: 1896 - RNA, 22 nt, Artificial Sequence
  synthetic oligonucleotide
cguguauuugacaagcugaguu

SEQ ID NO: 1897 - RNA, 20 nt, Artificial Sequence
  synthetic oligonucleotide
cguguauuugacaagcugag

SEQ ID NO: 1898 - RNA, 14 nt, Artificial Sequence
  synthetic oligonucleotide
uugucaaauacacg

SEQ ID NO: 1899 - RNA, 21 nt, Artificial Sequence
  synthetic oligonucleotide
caagucacuagugguuccguu

SEQ ID NO: 1900 - RNA, 20 nt, Artificial Sequence
  synthetic oligonucleotide
caagucacuagugguuccgu

SEQ ID NO: 1901 - RNA, 14 nt, Artificial Sequence
  synthetic oligonucleotide
ccacuagugacuug

SEQ ID NO: 1902 - RNA, 23 nt, Artificial Sequence
  synthetic oligonucleotide
aaaauggugcccuagugacuaca

SEQ ID NO: 1903 - RNA, 20 nt, Artificial Sequence
  synthetic oligonucleotide
aaaauggugcccuagugacu

SEQ ID NO: 1904 - RNA, 14 nt, Artificial Sequence
  synthetic oligonucleotide
uagggcaccauuuu

SEQ ID NO: 1905 - RNA, 22 nt, Artificial Sequence
  synthetic oligonucleotide
ucugcaagugucagaggcgagg

SEQ ID NO: 1906 - RNA, 20 nt, Artificial Sequence
  synthetic oligonucleotide
ucugcaagugucagaggcga

SEQ ID NO: 1907 - RNA, 14 nt, Artificial Sequence
  synthetic oligonucleotide
cugacacuugcaga

SEQ ID NO: 1908 - RNA, 21 nt, Artificial Sequence
  synthetic oligonucleotide
ugacagcgcccugccuggcuc

SEQ ID NO: 1909 - RNA, 20 nt, Artificial Sequence
  synthetic oligonucleotide
ugacagcgcccugccuggcu

SEQ ID NO: 1910 - RNA, 14 nt, Artificial Sequence
  synthetic oligonucleotide
gcagggcgcuguca

SEQ ID NO: 1911 - RNA, 24 nt, Artificial Sequence
  synthetic oligonucleotide
agcgcgggcugagcgcugccaguc

SEQ ID NO: 1912 - RNA, 20 nt, Artificial Sequence
  synthetic oligonucleotide
agcgcgggcugagcgcugcc

SEQ ID NO: 1913 - RNA, 14 nt, Artificial Sequence
  synthetic oligonucleotide
gcucagcccgcgcu

SEQ ID NO: 1914 - RNA, 22 nt, Artificial Sequence
  synthetic oligonucleotide
gagagcaguguguguugccugg

SEQ ID NO: 1915 - RNA, 20 nt, Artificial Sequence
  synthetic oligonucleotide
gagagcaguguguguugccu

SEQ ID NO: 1916 - RNA, 14 nt, Artificial Sequence
  synthetic oligonucleotide
cacacacugcucuc

SEQ ID NO: 1917 - RNA, 22 nt, Artificial Sequence
  synthetic oligonucleotide
auuguccuugcuguuuggagau

SEQ ID NO: 1918 - RNA, 20 nt, Artificial Sequence
  synthetic oligonucleotide
auuguccuugcuguuuggag

SEQ ID NO: 1919 - RNA, 14 nt, Artificial Sequence
  synthetic oligonucleotide
acagcaaggacaau

SEQ ID NO: 1920 - RNA, 21 nt, Artificial Sequence
  synthetic oligonucleotide
auccccagauacaauggacaa

SEQ ID NO: 1921 - RNA, 20 nt, Artificial Sequence
  synthetic oligonucleotide
auccccagauacaauggaca

SEQ ID NO: 1922 - RNA, 14 nt, Artificial Sequence
  synthetic oligonucleotide
uuguaucuggggau

SEQ ID NO: 1923 - RNA, 21 nt, Artificial Sequence
  synthetic oligonucleotide
aucacauugccagggauuucc

SEQ ID NO: 1924 - RNA, 20 nt, Artificial Sequence
  synthetic oligonucleotide
aucacauugccagggauuuc

SEQ ID NO: 1925 - RNA, 14 nt, Artificial Sequence
  synthetic oligonucleotide
ccuggcaaugugau

SEQ ID NO: 1926 - RNA, 22 nt, Artificial Sequence
  synthetic oligonucleotide
gggguuccuggggaugggauuu

SEQ ID NO: 1927 - RNA, 20 nt, Artificial Sequence
  synthetic oligonucleotide
gggguuccuggggaugggau

SEQ ID NO: 1928 - RNA, 14 nt, Artificial Sequence
  synthetic oligonucleotide
uccccaggaacccc

SEQ ID NO: 1929 - RNA, 21 nt, Artificial Sequence
  synthetic oligonucleotide
aucacauugccagggauuacc

SEQ ID NO: 1930 - RNA, 20 nt, Artificial Sequence
  synthetic oligonucleotide
aucacauugccagggauuac

SEQ ID NO: 1931 - RNA, 14 nt, Artificial Sequence
  synthetic oligonucleotide
ccuggcaaugugau

SEQ ID NO: 1932 - RNA, 22 nt, Artificial Sequence
  synthetic oligonucleotide
uggguuccuggcaugcugauuu

SEQ ID NO: 1933 - RNA, 20 nt, Artificial Sequence
  synthetic oligonucleotide
uggguuccuggcaugcugau

SEQ ID NO: 1934 - RNA, 14 nt, Artificial Sequence
  synthetic oligonucleotide
augccaggaaccca

SEQ ID NO: 1935 - RNA, 22 nt, Artificial Sequence
  synthetic oligonucleotide
aucacauugccagugauuaccc

SEQ ID NO: 1936 - RNA, 20 nt, Artificial Sequence
  synthetic oligonucleotide
aucacauugccagugauuac

SEQ ID NO: 1937 - RNA, 14 nt, Artificial Sequence
  synthetic oligonucleotide
acuggcaaugugau

SEQ ID NO: 1938 - RNA, 22 nt, Artificial Sequence
  synthetic oligonucleotide
uggcucaguucagcaggaacag

SEQ ID NO: 1939 - RNA, 20 nt, Artificial Sequence
  synthetic oligonucleotide
uggcucaguucagcaggaac

SEQ ID NO: 1940 - RNA, 14 nt, Artificial Sequence
  synthetic oligonucleotide
gcugaacugagcca

SEQ ID NO: 1941 - RNA, 22 nt, Artificial Sequence
  synthetic oligonucleotide
ugccuacugagcugauaucagu

SEQ ID NO: 1942 - RNA, 20 nt, Artificial Sequence
  synthetic oligonucleotide
ugccuacugagcugauauca

SEQ ID NO: 1943 - RNA, 14 nt, Artificial Sequence
  synthetic oligonucleotide
cagcucaguaggca

SEQ ID NO: 1944 - RNA, 22 nt, Artificial Sequence
  synthetic oligonucleotide
ugccuacugagcugaaacacag

SEQ ID NO: 1945 - RNA, 20 nt, Artificial Sequence
  synthetic oligonucleotide
ugccuacugagcugaaacac

SEQ ID NO: 1946 - RNA, 14 nt, Artificial Sequence
  synthetic oligonucleotide
cagcucaguaggca

SEQ ID NO: 1947 - RNA, 22 nt, Artificial Sequence
  synthetic oligonucleotide
cauugcacuugucucggucuga

SEQ ID NO: 1948 - RNA, 20 nt, Artificial Sequence
  synthetic oligonucleotide
cauugcacuugucucggucu

SEQ ID NO: 1949 - RNA, 14 nt, Artificial Sequence
  synthetic oligonucleotide
agacaagugcaaug

SEQ ID NO: 1950 - RNA, 21 nt, Artificial Sequence
  synthetic oligonucleotide
aggcggagacuugggcaauug

SEQ ID NO: 1951 - RNA, 20 nt, Artificial Sequence
  synthetic oligonucleotide
aggcggagacuugggcaauu

SEQ ID NO: 1952 - RNA, 14 nt, Artificial Sequence
  synthetic oligonucleotide
ccaagucuccgccu

SEQ ID NO: 1953 - RNA, 22 nt, Artificial Sequence
  synthetic oligonucleotide
uucaaguaauccaggauaggcu

SEQ ID NO: 1954 - RNA, 20 nt, Artificial Sequence
  synthetic oligonucleotide
uucaaguaauccaggauagg

SEQ ID NO: 1955 - RNA, 14 nt, Artificial Sequence
  synthetic oligonucleotide
cuggauuacuugaa

SEQ ID NO: 1956 - RNA, 22 nt, Artificial Sequence
  synthetic oligonucleotide
ccuauucuugguuacuugcacg

SEQ ID NO: 1957 - RNA, 20 nt, Artificial Sequence
  synthetic oligonucleotide
ccuauucuugguuacuugca

SEQ ID NO: 1958 - RNA, 14 nt, Artificial Sequence
  synthetic oligonucleotide
uaaccaagaauagg

SEQ ID NO: 1959 - RNA, 22 nt, Artificial Sequence
  synthetic oligonucleotide
ccuauucuugauuacuuguuuc

SEQ ID NO: 1960 - RNA, 20 nt, Artificial Sequence
  synthetic oligonucleotide
ccuauucuugauuacuuguu

SEQ ID NO: 1961 - RNA, 14 nt, Artificial Sequence
  synthetic oligonucleotide
uaaucaagaauagg

SEQ ID NO: 1962 - RNA, 21 nt, Artificial Sequence
  synthetic oligonucleotide
uucaaguaauucaggauaggu

SEQ ID NO: 1963 - RNA, 20 nt, Artificial Sequence
  synthetic oligonucleotide
uucaaguaauucaggauagg

SEQ ID NO: 1964 - RNA, 14 nt, Artificial Sequence
  synthetic oligonucleotide
cugaauuacuugaa

SEQ ID NO: 1965 - RNA, 22 nt, Artificial Sequence
  synthetic oligonucleotide
ccuguucuccauuacuuggcuc

SEQ ID NO: 1966 - RNA, 20 nt, Artificial Sequence
  synthetic oligonucleotide
ccuguucuccauuacuuggc

SEQ ID NO: 1967 - RNA, 14 nt, Artificial Sequence
  synthetic oligonucleotide
uaauggagaacagg

SEQ ID NO: 1968 - RNA, 21 nt, Artificial Sequence
  synthetic oligonucleotide
uucacaguggcuaaguuccgc

SEQ ID NO: 1969 - RNA, 20 nt, Artificial Sequence
  synthetic oligonucleotide
uucacaguggcuaaguuccg

SEQ ID NO: 1970 - RNA, 14 nt, Artificial Sequence
  synthetic oligonucleotide
uuagccacugugaa

SEQ ID NO: 1971 - RNA, 22 nt, Artificial Sequence
  synthetic oligonucleotide
agggcuuagcugcuugugagca

SEQ ID NO: 1972 - RNA, 20 nt, Artificial Sequence
  synthetic oligonucleotide
agggcuuagcugcuugugag

SEQ ID NO: 1973 - RNA, 14 nt, Artificial Sequence
  synthetic oligonucleotide
agcagcuaagcccu

SEQ ID NO: 1974 - RNA, 21 nt, Artificial Sequence
  synthetic oligonucleotide
uucacaguggcuaaguucugc

SEQ ID NO: 1975 - RNA, 20 nt, Artificial Sequence
  synthetic oligonucleotide
uucacaguggcuaaguucug

SEQ ID NO: 1976 - RNA, 14 nt, Artificial Sequence
  synthetic oligonucleotide
uuagccacugugaa

SEQ ID NO: 1977 - RNA, 22 nt, Artificial Sequence
  synthetic oligonucleotide
agagcuuagcugauuggugaac

SEQ ID NO: 1978 - RNA, 20 nt, Artificial Sequence
  synthetic oligonucleotide
agagcuuagcugauugguga

SEQ ID NO: 1979 - RNA, 14 nt, Artificial Sequence
  synthetic oligonucleotide
aucagcuaagcucu

SEQ ID NO: 1980 - RNA, 22 nt, Artificial Sequence
  synthetic oligonucleotide
cacuagauugugagcuccugga

SEQ ID NO: 1981 - RNA, 20 nt, Artificial Sequence
  synthetic oligonucleotide
cacuagauugugagcuccug

SEQ ID NO: 1982 - RNA, 14 nt, Artificial Sequence
  synthetic oligonucleotide
cucacaaucuagug

SEQ ID NO: 1983 - RNA, 22 nt, Artificial Sequence
  synthetic oligonucleotide
aaggagcucacagucuauugag

SEQ ID NO: 1984 - RNA, 20 nt, Artificial Sequence
  synthetic oligonucleotide
aaggagcucacagucuauug

SEQ ID NO: 1985 - RNA, 14 nt, Artificial Sequence
  synthetic oligonucleotide
acugugagcuccuu

SEQ ID NO: 1986 - RNA, 19 nt, Artificial Sequence
  synthetic oligonucleotide
ggggccuggcggugggcgg

SEQ ID NO: 1987 - RNA, 19 nt, Artificial Sequence
  synthetic oligonucleotide
ggggccuggcggugggcgg

SEQ ID NO: 1988 - RNA, 14 nt, Artificial Sequence
  synthetic oligonucleotide
caccgccaggcccc

SEQ ID NO: 1989 - RNA, 21 nt, Artificial Sequence
  synthetic oligonucleotide
guuagggccaacaucucuugg

SEQ ID NO: 1990 - RNA, 20 nt, Artificial Sequence
  synthetic oligonucleotide
guuagggccaacaucucuug

SEQ ID NO: 1991 - RNA, 14 nt, Artificial Sequence
  synthetic oligonucleotide
auguuggcccuaac

SEQ ID NO: 1992 - RNA, 22 nt, Artificial Sequence
  synthetic oligonucleotide
gaggguuggguggaggcucucc

SEQ ID NO: 1993 - RNA, 20 nt, Artificial Sequence
  synthetic oligonucleotide
gaggguuggguggaggcucu

SEQ ID NO: 1994 - RNA, 14 nt, Artificial Sequence
  synthetic oligonucleotide
uccacccaacccuc

SEQ ID NO: 1995 - RNA, 21 nt, Artificial Sequence
  synthetic oligonucleotide
agggcccccccucaauccugu

SEQ ID NO: 1996 - RNA, 20 nt, Artificial Sequence
  synthetic oligonucleotide
agggcccccccucaauccug

SEQ ID NO: 1997 - RNA, 14 nt, Artificial Sequence
  synthetic oligonucleotide
ugagggggggcccu

SEQ ID NO: 1998 - RNA, 21 nt, Artificial Sequence
  synthetic oligonucleotide
auguaugugugcaugugcaug

SEQ ID NO: 1999 - RNA, 20 nt, Artificial Sequence
  synthetic oligonucleotide
auguaugugugcaugugcau

SEQ ID NO: 2000 - RNA, 14 nt, Artificial Sequence
  synthetic oligonucleotide
augcacacauacau

SEQ ID NO: 2001 - RNA, 24 nt, Artificial Sequence
  synthetic oligonucleotide
agcagaagcagggagguucuccca

SEQ ID NO: 2002 - RNA, 20 nt, Artificial Sequence
  synthetic oligonucleotide
agcagaagcagggagguucu

SEQ ID NO: 2003 - RNA, 14 nt, Artificial Sequence
  synthetic oligonucleotide
ucccugcuucugcu

SEQ ID NO: 2004 - RNA, 22 nt, Artificial Sequence
  synthetic oligonucleotide
uaugugggaugguaaaccgcuu

SEQ ID NO: 2005 - RNA, 20 nt, Artificial Sequence
  synthetic oligonucleotide
uaugugggaugguaaaccgc

SEQ ID NO: 2006 - RNA, 14 nt, Artificial Sequence
  synthetic oligonucleotide
uaccaucccacaua

SEQ ID NO: 2007 - RNA, 22 nt, Artificial Sequence
  synthetic oligonucleotide
ugguuuaccgucccacauacau

SEQ ID NO: 2008 - RNA, 20 nt, Artificial Sequence
  synthetic oligonucleotide
ugguuuaccgucccacauac

SEQ ID NO: 2009 - RNA, 14 nt, Artificial Sequence
  synthetic oligonucleotide
gggacgguaaacca

SEQ ID NO: 2010 - RNA, 22 nt, Artificial Sequence
  synthetic oligonucleotide
uagcaccaucugaaaucgguua

SEQ ID NO: 2011 - RNA, 20 nt, Artificial Sequence
  synthetic oligonucleotide
uagcaccaucugaaaucggu

SEQ ID NO: 2012 - RNA, 14 nt, Artificial Sequence
  synthetic oligonucleotide
uucagauggugcua

SEQ ID NO: 2013 - RNA, 22 nt, Artificial Sequence
  synthetic oligonucleotide
acugauuucuuuugguguucag

SEQ ID NO: 2014 - RNA, 20 nt, Artificial Sequence
  synthetic oligonucleotide
acugauuucuuuugguguuc

SEQ ID NO: 2015 - RNA, 14 nt, Artificial Sequence
  synthetic oligonucleotide
caaaagaaaucagu

SEQ ID NO: 2016 - RNA, 23 nt, Artificial Sequence
  synthetic oligonucleotide
uagcaccauuugaaaucaguguu

SEQ ID NO: 2017 - RNA, 20 nt, Artificial Sequence
  synthetic oligonucleotide
uagcaccauuugaaaucagu

SEQ ID NO: 2018 - RNA, 14 nt, Artificial Sequence
  synthetic oligonucleotide
uucaaauggugcua

SEQ ID NO: 2019 - RNA, 24 nt, Artificial Sequence
  synthetic oligonucleotide
gcugguuucauauggugguuuaga

SEQ ID NO: 2020 - RNA, 20 nt, Artificial Sequence
  synthetic oligonucleotide
gcugguuucauauggugguu

SEQ ID NO: 2021 - RNA, 14 nt, Artificial Sequence
  synthetic oligonucleotide
cauaugaaaccagc

SEQ ID NO: 2022 - RNA, 22 nt, Artificial Sequence
  synthetic oligonucleotide
cugguuucacaugguggcuuag

SEQ ID NO: 2023 - RNA, 20 nt, Artificial Sequence
  synthetic oligonucleotide
cugguuucacaugguggcuu

SEQ ID NO: 2024 - RNA, 14 nt, Artificial Sequence
  synthetic oligonucleotide
ccaugugaaaccag

SEQ ID NO: 2025 - RNA, 22 nt, Artificial Sequence
  synthetic oligonucleotide
uagcaccauuugaaaucgguua

SEQ ID NO: 2026 - RNA, 20 nt, Artificial Sequence
  synthetic oligonucleotide
uagcaccauuugaaaucggu

SEQ ID NO: 2027 - RNA, 14 nt, Artificial Sequence
  synthetic oligonucleotide
uucaaauggugcua

SEQ ID NO: 2028 - RNA, 22 nt, Artificial Sequence
  synthetic oligonucleotide
ugaccgauuucuccugguguuc

SEQ ID NO: 2029 - RNA, 20 nt, Artificial Sequence
  synthetic oligonucleotide
ugaccgauuucuccuggugu

SEQ ID NO: 2030 - RNA, 14 nt, Artificial Sequence
  synthetic oligonucleotide
ggagaaaucgguca

SEQ ID NO: 2031 - RNA, 22 nt, Artificial Sequence
  synthetic oligonucleotide
uauacaagggcagacucucucu

SEQ ID NO: 2032 - RNA, 20 nt, Artificial Sequence
  synthetic oligonucleotide
uauacaagggcagacucucu

SEQ ID NO: 2033 - RNA, 14 nt, Artificial Sequence
  synthetic oligonucleotide
ucugcccuuguaua

SEQ ID NO: 2034 - RNA, 23 nt, Artificial Sequence
  synthetic oligonucleotide
cagugcaauaguauugucaaagc

SEQ ID NO: 2035 - RNA, 20 nt, Artificial Sequence
  synthetic oligonucleotide
cagugcaauaguauugucaa

SEQ ID NO: 2036 - RNA, 14 nt, Artificial Sequence
  synthetic oligonucleotide
auacuauugcacug

SEQ ID NO: 2037 - RNA, 23 nt, Artificial Sequence
  synthetic oligonucleotide
cagugcaaugauauugucaaagc

SEQ ID NO: 2038 - RNA, 20 nt, Artificial Sequence
  synthetic oligonucleotide
cagugcaaugauauugucaa

SEQ ID NO: 2039 - RNA, 14 nt, Artificial Sequence
  synthetic oligonucleotide
auaucauugcacug

SEQ ID NO: 2040 - RNA, 23 nt, Artificial Sequence
  synthetic oligonucleotide
uaagugcuuccauguuuugguga

SEQ ID NO: 2041 - RNA, 20 nt, Artificial Sequence
  synthetic oligonucleotide
uaagugcuuccauguuuugg

SEQ ID NO: 2042 - RNA, 14 nt, Artificial Sequence
  synthetic oligonucleotide
cauggaagcacuua

SEQ ID NO: 2043 - RNA, 23 nt, Artificial Sequence
  synthetic oligonucleotide
acuuaaacguggauguacuugcu

SEQ ID NO: 2044 - RNA, 20 nt, Artificial Sequence
  synthetic oligonucleotide
acuuaaacguggauguacuu

SEQ ID NO: 2045 - RNA, 14 nt, Artificial Sequence
  synthetic oligonucleotide
auccacguuuaagu

SEQ ID NO: 2046 - RNA, 23 nt, Artificial Sequence
  synthetic oligonucleotide
uaagugcuuccauguuuuaguag

SEQ ID NO: 2047 - RNA, 20 nt, Artificial Sequence
  synthetic oligonucleotide
uaagugcuuccauguuuuag

SEQ ID NO: 2048 - RNA, 14 nt, Artificial Sequence
  synthetic oligonucleotide
cauggaagcacuua

SEQ ID NO: 2049 - RNA, 22 nt, Artificial Sequence
  synthetic oligonucleotide
acuuuaacauggaagugcuuuc

SEQ ID NO: 2050 - RNA, 20 nt, Artificial Sequence
  synthetic oligonucleotide
acuuuaacauggaagugcuu

SEQ ID NO: 2051 - RNA, 14 nt, Artificial Sequence
  synthetic oligonucleotide
uuccauguuaaagu

SEQ ID NO: 2052 - RNA, 23 nt, Artificial Sequence
  synthetic oligonucleotide
uaagugcuuccauguuucagugg

SEQ ID NO: 2053 - RNA, 20 nt, Artificial Sequence
  synthetic oligonucleotide
uaagugcuuccauguuucag

SEQ ID NO: 2054 - RNA, 14 nt, Artificial Sequence
  synthetic oligonucleotide
cauggaagcacuua

SEQ ID NO: 2055 - RNA, 22 nt, Artificial Sequence
  synthetic oligonucleotide
uuuaacauggggguaccugcug

SEQ ID NO: 2056 - RNA, 20 nt, Artificial Sequence
  synthetic oligonucleotide
uuuaacauggggguaccugc

SEQ ID NO: 2057 - RNA, 14 nt, Artificial Sequence
  synthetic oligonucleotide
acccccauguuaaa

SEQ ID NO: 2058 - RNA, 23 nt, Artificial Sequence
  synthetic oligonucleotide
uaagugcuuccauguuugagugu

SEQ ID NO: 2059 - RNA, 20 nt, Artificial Sequence
  synthetic oligonucleotide
uaagugcuuccauguuugag

SEQ ID NO: 2060 - RNA, 14 nt, Artificial Sequence
  synthetic oligonucleotide
cauggaagcacuua

SEQ ID NO: 2061 - RNA, 22 nt, Artificial Sequence
  synthetic oligonucleotide
acuuuaacauggaggcacuugc

SEQ ID NO: 2062 - RNA, 20 nt, Artificial Sequence
  synthetic oligonucleotide
acuuuaacauggaggcacuu

SEQ ID NO: 2063 - RNA, 14 nt, Artificial Sequence
  synthetic oligonucleotide
cuccauguuaaagu

SEQ ID NO: 2064 - RNA, 17 nt, Artificial Sequence
  synthetic oligonucleotide
uaagugcuuccaugcuu

SEQ ID NO: 2065 - RNA, 17 nt, Artificial Sequence
  synthetic oligonucleotide
uaagugcuuccaugcuu

SEQ ID NO: 2066 - RNA, 14 nt, Artificial Sequence
  synthetic oligonucleotide
cauggaagcacuua

SEQ ID NO: 2067 - RNA, 17 nt, Artificial Sequence
  synthetic oligonucleotide
uaauugcuuccauguuu

SEQ ID NO: 2068 - RNA, 17 nt, Artificial Sequence
  synthetic oligonucleotide
uaauugcuuccauguuu

SEQ ID NO: 2069 - RNA, 14 nt, Artificial Sequence
  synthetic oligonucleotide
cauggaagcaauua

SEQ ID NO: 2070 - RNA, 23 nt, Artificial Sequence
  synthetic oligonucleotide
ucagcaccaggauauuguuggag

SEQ ID NO: 2071 - RNA, 20 nt, Artificial Sequence
  synthetic oligonucleotide
ucagcaccaggauauuguug

SEQ ID NO: 2072 - RNA, 14 nt, Artificial Sequence
  synthetic oligonucleotide
uauccuggugcuga

SEQ ID NO: 2073 - RNA, 23 nt, Artificial Sequence
  synthetic oligonucleotide
ucaacaaaaucacugaugcugga

SEQ ID NO: 2074 - RNA, 20 nt, Artificial Sequence
  synthetic oligonucleotide
ucaacaaaaucacugaugcu

SEQ ID NO: 2075 - RNA, 14 nt, Artificial Sequence
  synthetic oligonucleotide
agugauuuuguuga

SEQ ID NO: 2076 - RNA, 22 nt, Artificial Sequence
  synthetic oligonucleotide
gauaucagcucaguaggcaccg

SEQ ID NO: 2077 - RNA, 20 nt, Artificial Sequence
  synthetic oligonucleotide
gauaucagcucaguaggcac

SEQ ID NO: 2078 - RNA, 14 nt, Artificial Sequence
  synthetic oligonucleotide
acugagcugauauc

SEQ ID NO: 2079 - RNA, 22 nt, Artificial Sequence
  synthetic oligonucleotide
uguaaacauccucgacuggaag

SEQ ID NO: 2080 - RNA, 20 nt, Artificial Sequence
  synthetic oligonucleotide
uguaaacauccucgacugga

SEQ ID NO: 2081 - RNA, 14 nt, Artificial Sequence
  synthetic oligonucleotide
cgaggauguuuaca

SEQ ID NO: 2082 - RNA, 22 nt, Artificial Sequence
  synthetic oligonucleotide
cuuucagucggauguuugcagc

SEQ ID NO: 2083 - RNA, 20 nt, Artificial Sequence
  synthetic oligonucleotide
cuuucagucggauguuugca

SEQ ID NO: 2084 - RNA, 14 nt, Artificial Sequence
  synthetic oligonucleotide
cauccgacugaaag

SEQ ID NO: 2085 - RNA, 22 nt, Artificial Sequence
  synthetic oligonucleotide
uguaaacauccuacacucagcu

SEQ ID NO: 2086 - RNA, 20 nt, Artificial Sequence
  synthetic oligonucleotide
uguaaacauccuacacucag

SEQ ID NO: 2087 - RNA, 14 nt, Artificial Sequence
  synthetic oligonucleotide
guaggauguuuaca

SEQ ID NO: 2088 - RNA, 22 nt, Artificial Sequence
  synthetic oligonucleotide
cugggagguggauguuuacuuc

SEQ ID NO: 2089 - RNA, 20 nt, Artificial Sequence
  synthetic oligonucleotide
cugggagguggauguuuacu

SEQ ID NO: 2090 - RNA, 14 nt, Artificial Sequence
  synthetic oligonucleotide
cauccaccucccag

SEQ ID NO: 2091 - RNA, 23 nt, Artificial Sequence
  synthetic oligonucleotide
uguaaacauccuacacucucagc

SEQ ID NO: 2092 - RNA, 20 nt, Artificial Sequence
  synthetic oligonucleotide
uguaaacauccuacacucuc

SEQ ID NO: 2093 - RNA, 14 nt, Artificial Sequence
  synthetic oligonucleotide
guaggauguuuaca

SEQ ID NO: 2094 - RNA, 22 nt, Artificial Sequence
  synthetic oligonucleotide
cugggagaggguuguuuacucc

SEQ ID NO: 2095 - RNA, 20 nt, Artificial Sequence
  synthetic oligonucleotide
cugggagaggguuguuuacu

SEQ ID NO: 2096 - RNA, 14 nt, Artificial Sequence
  synthetic oligonucleotide
caacccucucccag

SEQ ID NO: 2097 - RNA, 22 nt, Artificial Sequence
  synthetic oligonucleotide
cugggagaaggcuguuuacucu

SEQ ID NO: 2098 - RNA, 20 nt, Artificial Sequence
  synthetic oligonucleotide
cugggagaaggcuguuuacu

SEQ ID NO: 2099 - RNA, 14 nt, Artificial Sequence
  synthetic oligonucleotide
cagccuucucccag

SEQ ID NO: 2100 - RNA, 22 nt, Artificial Sequence
  synthetic oligonucleotide
uguaaacauccccgacuggaag

SEQ ID NO: 2101 - RNA, 20 nt, Artificial Sequence
  synthetic oligonucleotide
uguaaacauccccgacugga

SEQ ID NO: 2102 - RNA, 14 nt, Artificial Sequence
  synthetic oligonucleotide
cggggauguuuaca

SEQ ID NO: 2103 - RNA, 22 nt, Artificial Sequence
  synthetic oligonucleotide
cuuucagucagauguuugcugc

SEQ ID NO: 2104 - RNA, 20 nt, Artificial Sequence
  synthetic oligonucleotide
cuuucagucagauguuugcu

SEQ ID NO: 2105 - RNA, 14 nt, Artificial Sequence
  synthetic oligonucleotide
caucugacugaaag

SEQ ID NO: 2106 - RNA, 22 nt, Artificial Sequence
  synthetic oligonucleotide
uguaaacauccuugacuggaag

SEQ ID NO: 2107 - RNA, 20 nt, Artificial Sequence
  synthetic oligonucleotide
uguaaacauccuugacugga

SEQ ID NO: 2108 - RNA, 14 nt, Artificial Sequence
  synthetic oligonucleotide
caaggauguuuaca

SEQ ID NO: 2109 - RNA, 22 nt, Artificial Sequence
  synthetic oligonucleotide
cuuucagucggauguuuacagc

SEQ ID NO: 2110 - RNA, 20 nt, Artificial Sequence
  synthetic oligonucleotide
cuuucagucggauguuuaca

SEQ ID NO: 2111 - RNA, 14 nt, Artificial Sequence
  synthetic oligonucleotide
cauccgacugaaag

SEQ ID NO: 2112 - RNA, 21 nt, Artificial Sequence
  synthetic oligonucleotide
aggcaagaugcuggcauagcu

SEQ ID NO: 2113 - RNA, 20 nt, Artificial Sequence
  synthetic oligonucleotide
aggcaagaugcuggcauagc

SEQ ID NO: 2114 - RNA, 14 nt, Artificial Sequence
  synthetic oligonucleotide
ccagcaucuugccu

SEQ ID NO: 2115 - RNA, 22 nt, Artificial Sequence
  synthetic oligonucleotide
ugcuaugccaacauauugccau

SEQ ID NO: 2116 - RNA, 20 nt, Artificial Sequence
  synthetic oligonucleotide
ugcuaugccaacauauugcc

SEQ ID NO: 2117 - RNA, 14 nt, Artificial Sequence
  synthetic oligonucleotide
auguuggcauagca

SEQ ID NO: 2118 - RNA, 20 nt, Artificial Sequence
  synthetic oligonucleotide
auauggguuuacuaguuggu

SEQ ID NO: 2119 - RNA, 20 nt, Artificial Sequence
  synthetic oligonucleotide
auauggguuuacuaguuggu

SEQ ID NO: 2120 - RNA, 14 nt, Artificial Sequence
  synthetic oligonucleotide
uaguaaacccauau

SEQ ID NO: 2121 - RNA, 22 nt, Artificial Sequence
  synthetic oligonucleotide
ugccuggaacauaguagggacu

SEQ ID NO: 2122 - RNA, 20 nt, Artificial Sequence
  synthetic oligonucleotide
ugccuggaacauaguaggga

SEQ ID NO: 2123 - RNA, 14 nt, Artificial Sequence
  synthetic oligonucleotide
cuauguuccaggca

SEQ ID NO: 2124 - RNA, 21 nt, Artificial Sequence
  synthetic oligonucleotide
auaggacucauauagugccag

SEQ ID NO: 2125 - RNA, 20 nt, Artificial Sequence
  synthetic oligonucleotide
auaggacucauauagugcca

SEQ ID NO: 2126 - RNA, 14 nt, Artificial Sequence
  synthetic oligonucleotide
uauaugaguccuau

SEQ ID NO: 2127 - RNA, 23 nt, Artificial Sequence
  synthetic oligonucleotide
ugugacugcauuaugaaaauucu

SEQ ID NO: 2128 - RNA, 20 nt, Artificial Sequence
  synthetic oligonucleotide
ugugacugcauuaugaaaau

SEQ ID NO: 2129 - RNA, 14 nt, Artificial Sequence
  synthetic oligonucleotide
auaaugcagucaca

SEQ ID NO: 2130 - RNA, 20 nt, Artificial Sequence
  synthetic oligonucleotide
uggcuuuuaacuuugauggc

SEQ ID NO: 2131 - RNA, 20 nt, Artificial Sequence
  synthetic oligonucleotide
uggcuuuuaacuuugauggc

SEQ ID NO: 2132 - RNA, 14 nt, Artificial Sequence
  synthetic oligonucleotide
aaaguuaaaagcca

SEQ ID NO: 2133 - RNA, 21 nt, Artificial Sequence
  synthetic oligonucleotide
cacagcaaguguagacaggca

SEQ ID NO: 2134 - RNA, 20 nt, Artificial Sequence
  synthetic oligonucleotide
cacagcaaguguagacaggc

SEQ ID NO: 2135 - RNA, 14 nt, Artificial Sequence
  synthetic oligonucleotide
cuacacuugcugug

SEQ ID NO: 2136 - RNA, 22 nt, Artificial Sequence
  synthetic oligonucleotide
uaaauagaguaggcaaaggaca

SEQ ID NO: 2137 - RNA, 20 nt, Artificial Sequence
  synthetic oligonucleotide
uaaauagaguaggcaaagga

SEQ ID NO: 2138 - RNA, 14 nt, Artificial Sequence
  synthetic oligonucleotide
gccuacucuauuua

SEQ ID NO: 2139 - RNA, 22 nt, Artificial Sequence
  synthetic oligonucleotide
guugggacaagaggacggucuu

SEQ ID NO: 2140 - RNA, 20 nt, Artificial Sequence
  synthetic oligonucleotide
guugggacaagaggacgguc

SEQ ID NO: 2141 - RNA, 14 nt, Artificial Sequence
  synthetic oligonucleotide
ccucuugucccaac

SEQ ID NO: 2142 - RNA, 17 nt, Artificial Sequence
  synthetic oligonucleotide
cagagaauuguuuaauc

SEQ ID NO: 2143 - RNA, 17 nt, Artificial Sequence
  synthetic oligonucleotide
cagagaauuguuuaauc

SEQ ID NO: 2144 - RNA, 14 nt, Artificial Sequence
  synthetic oligonucleotide
uaaacaauucucug

SEQ ID NO: 2145 - RNA, 21 nt, Artificial Sequence
  synthetic oligonucleotide
uucgcgggcgaaggcaaaguc

SEQ ID NO: 2146 - RNA, 20 nt, Artificial Sequence
  synthetic oligonucleotide
uucgcgggcgaaggcaaagu

SEQ ID NO: 2147 - RNA, 14 nt, Artificial Sequence
  synthetic oligonucleotide
ccuucgcccgcgaa

SEQ ID NO: 2148 - RNA, 20 nt, Artificial Sequence
  synthetic oligonucleotide
uagaggaagcuguggagaga

SEQ ID NO: 2149 - RNA, 20 nt, Artificial Sequence
  synthetic oligonucleotide
uagaggaagcuguggagaga

SEQ ID NO: 2150 - RNA, 14 nt, Artificial Sequence
  synthetic oligonucleotide
cacagcuuccucua

SEQ ID NO: 2151 - RNA, 22 nt, Artificial Sequence
  synthetic oligonucleotide
caucuggcauccgucacacaga

SEQ ID NO: 2152 - RNA, 20 nt, Artificial Sequence
  synthetic oligonucleotide
caucuggcauccgucacaca

SEQ ID NO: 2153 - RNA, 14 nt, Artificial Sequence
  synthetic oligonucleotide
acggaugccagaug

SEQ ID NO: 2154 - RNA, 22 nt, Artificial Sequence
  synthetic oligonucleotide
ugagggacagaugccagaagca

SEQ ID NO: 2155 - RNA, 20 nt, Artificial Sequence
  synthetic oligonucleotide
ugagggacagaugccagaag

SEQ ID NO: 2156 - RNA, 14 nt, Artificial Sequence
  synthetic oligonucleotide
gcaucugucccuca

SEQ ID NO: 2157 - RNA, 23 nt, Artificial Sequence
  synthetic oligonucleotide
aucagggcuuguggaaugggaag

SEQ ID NO: 2158 - RNA, 20 nt, Artificial Sequence
  synthetic oligonucleotide
aucagggcuuguggaauggg

SEQ ID NO: 2159 - RNA, 14 nt, Artificial Sequence
  synthetic oligonucleotide
ccacaagcccugau

SEQ ID NO: 2160 - RNA, 23 nt, Artificial Sequence
  synthetic oligonucleotide
ucuggcaaguaaaaaacucucau

SEQ ID NO: 2161 - RNA, 20 nt, Artificial Sequence
  synthetic oligonucleotide
ucuggcaaguaaaaaacucu

SEQ ID NO: 2162 - RNA, 14 nt, Artificial Sequence
  synthetic oligonucleotide
uuuuacuugccaga

SEQ ID NO: 2163 - RNA, 22 nt, Artificial Sequence
  synthetic oligonucleotide
gcaguaguguagagauugguuu

SEQ ID NO: 2164 - RNA, 20 nt, Artificial Sequence
  synthetic oligonucleotide
gcaguaguguagagauuggu

SEQ ID NO: 2165 - RNA, 14 nt, Artificial Sequence
  synthetic oligonucleotide
cucuacacuacugc

SEQ ID NO: 2166 - RNA, 21 nt, Artificial Sequence
  synthetic oligonucleotide
gcugcaccggagacuggguaa

SEQ ID NO: 2167 - RNA, 20 nt, Artificial Sequence
  synthetic oligonucleotide
gcugcaccggagacugggua

SEQ ID NO: 2168 - RNA, 14 nt, Artificial Sequence
  synthetic oligonucleotide
gucuccggugcagc

SEQ ID NO: 2169 - RNA, 21 nt, Artificial Sequence
  synthetic oligonucleotide
uacccagucuccggugcagcc

SEQ ID NO: 2170 - RNA, 20 nt, Artificial Sequence
  synthetic oligonucleotide
uacccagucuccggugcagc

SEQ ID NO: 2171 - RNA, 14 nt, Artificial Sequence
  synthetic oligonucleotide
ccggagacugggua

SEQ ID NO: 2172 - RNA, 23 nt, Artificial Sequence
  synthetic oligonucleotide
ucgaggacugguggaagggccuu

SEQ ID NO: 2173 - RNA, 20 nt, Artificial Sequence
  synthetic oligonucleotide
ucgaggacugguggaagggc

SEQ ID NO: 2174 - RNA, 14 nt, Artificial Sequence
  synthetic oligonucleotide
ccaccaguccucga

SEQ ID NO: 2175 - RNA, 24 nt, Artificial Sequence
  synthetic oligonucleotide
uggguagagaaggagcucagagga

SEQ ID NO: 2176 - RNA, 20 nt, Artificial Sequence
  synthetic oligonucleotide
uggguagagaaggagcucag

SEQ ID NO: 2177 - RNA, 14 nt, Artificial Sequence
  synthetic oligonucleotide
uccuucucuaccca

SEQ ID NO: 2178 - RNA, 22 nt, Artificial Sequence
  synthetic oligonucleotide
uaaagaacucuuaaaacccaau

SEQ ID NO: 2179 - RNA, 20 nt, Artificial Sequence
  synthetic oligonucleotide
uaaagaacucuuaaaaccca

SEQ ID NO: 2180 - RNA, 14 nt, Artificial Sequence
  synthetic oligonucleotide
uuaagaguucuuua

SEQ ID NO: 2181 - RNA, 23 nt, Artificial Sequence
  synthetic oligonucleotide
ugauggauaaaagacuacauauu

SEQ ID NO: 2182 - RNA, 20 nt, Artificial Sequence
  synthetic oligonucleotide
ugauggauaaaagacuacau

SEQ ID NO: 2183 - RNA, 14 nt, Artificial Sequence
  synthetic oligonucleotide
ucuuuuauccauca

SEQ ID NO: 2184 - RNA, 22 nt, Artificial Sequence
  synthetic oligonucleotide
ugccuaggcugagacugcagug

SEQ ID NO: 2185 - RNA, 20 nt, Artificial Sequence
  synthetic oligonucleotide
ugccuaggcugagacugcag

SEQ ID NO: 2186 - RNA, 14 nt, Artificial Sequence
  synthetic oligonucleotide
ucucagccuaggca

SEQ ID NO: 2187 - RNA, 23 nt, Artificial Sequence
  synthetic oligonucleotide
cugacugaauagguagggucauu

SEQ ID NO: 2188 - RNA, 20 nt, Artificial Sequence
  synthetic oligonucleotide
cugacugaauagguaggguc

SEQ ID NO: 2189 - RNA, 14 nt, Artificial Sequence
  synthetic oligonucleotide
accuauucagucag

SEQ ID NO: 2190 - RNA, 24 nt, Artificial Sequence
  synthetic oligonucleotide
ucuguagccugggagcaauggggu

SEQ ID NO: 2191 - RNA, 20 nt, Artificial Sequence
  synthetic oligonucleotide
ucuguagccugggagcaaug

SEQ ID NO: 2192 - RNA, 14 nt, Artificial Sequence
  synthetic oligonucleotide
ucccaggcuacaga

SEQ ID NO: 2193 - RNA, 24 nt, Artificial Sequence
  synthetic oligonucleotide
uguggacagugagguagagggagu

SEQ ID NO: 2194 - RNA, 20 nt, Artificial Sequence
  synthetic oligonucleotide
uguggacagugagguagagg

SEQ ID NO: 2195 - RNA, 14 nt, Artificial Sequence
  synthetic oligonucleotide
ccucacuguccaca

SEQ ID NO: 2196 - RNA, 23 nt, Artificial Sequence
  synthetic oligonucleotide
uaggagcucaacagaugccuguu

SEQ ID NO: 2197 - RNA, 20 nt, Artificial Sequence
  synthetic oligonucleotide
uaggagcucaacagaugccu

SEQ ID NO: 2198 - RNA, 14 nt, Artificial Sequence
  synthetic oligonucleotide
cuguugagcuccua

SEQ ID NO: 2199 - RNA, 22 nt, Artificial Sequence
  synthetic oligonucleotide
agcuuuugggaauucagguagu

SEQ ID NO: 2200 - RNA, 20 nt, Artificial Sequence
  synthetic oligonucleotide
agcuuuugggaauucaggua

SEQ ID NO: 2201 - RNA, 14 nt, Artificial Sequence
  synthetic oligonucleotide
aauucccaaaagcu

SEQ ID NO: 2202 - RNA, 19 nt, Artificial Sequence
  synthetic oligonucleotide
gagggcggguggaggagga

SEQ ID NO: 2203 - RNA, 19 nt, Artificial Sequence
  synthetic oligonucleotide
gagggcggguggaggagga

SEQ ID NO: 2204 - RNA, 14 nt, Artificial Sequence
  synthetic oligonucleotide
cuccacccgcccuc

SEQ ID NO: 2205 - RNA, 22 nt, Artificial Sequence
  synthetic oligonucleotide
aaggccuuucugaaccuucaga

SEQ ID NO: 2206 - RNA, 20 nt, Artificial Sequence
  synthetic oligonucleotide
aaggccuuucugaaccuuca

SEQ ID NO: 2207 - RNA, 14 nt, Artificial Sequence
  synthetic oligonucleotide
uucagaaaggccuu

SEQ ID NO: 2208 - RNA, 25 nt, Artificial Sequence
  synthetic oligonucleotide
auaacauuguaaagcgcuucuuucg

SEQ ID NO: 2209 - RNA, 20 nt, Artificial Sequence
  synthetic oligonucleotide
auaacauuguaaagcgcuuc

SEQ ID NO: 2210 - RNA, 14 nt, Artificial Sequence
  synthetic oligonucleotide
cuuuacaauguuau

SEQ ID NO: 2211 - RNA, 22 nt, Artificial Sequence
  synthetic oligonucleotide
auauaccuguucggucucuuua

SEQ ID NO: 2212 - RNA, 20 nt, Artificial Sequence
  synthetic oligonucleotide
auauaccuguucggucucuu

SEQ ID NO: 2213 - RNA, 14 nt, Artificial Sequence
  synthetic oligonucleotide
ccgaacagguauau

SEQ ID NO: 2214 - RNA, 22 nt, Artificial Sequence
  synthetic oligonucleotide
aggggaccaaagagauauauag

SEQ ID NO: 2215 - RNA, 20 nt, Artificial Sequence
  synthetic oligonucleotide
aggggaccaaagagauauau

SEQ ID NO: 2216 - RNA, 14 nt, Artificial Sequence
  synthetic oligonucleotide
cucuuugguccccu

SEQ ID NO: 2217 - RNA, 24 nt, Artificial Sequence
  synthetic oligonucleotide
agauauuuugaguguuuggaauug

SEQ ID NO: 2218 - RNA, 20 nt, Artificial Sequence
  synthetic oligonucleotide
agauauuuugaguguuugga

SEQ ID NO: 2219 - RNA, 14 nt, Artificial Sequence
  synthetic oligonucleotide
cacucaaaauaucu

SEQ ID NO: 2220 - RNA, 22 nt, Artificial Sequence
  synthetic oligonucleotide
caugcuaggauagaaagaaugg

SEQ ID NO: 2221 - RNA, 20 nt, Artificial Sequence
  synthetic oligonucleotide
caugcuaggauagaaagaau

SEQ ID NO: 2222 - RNA, 14 nt, Artificial Sequence
  synthetic oligonucleotide
ucuauccuagcaug

SEQ ID NO: 2223 - RNA, 24 nt, Artificial Sequence
  synthetic oligonucleotide
gguugggcagugaggaggguguga

SEQ ID NO: 2224 - RNA, 20 nt, Artificial Sequence
  synthetic oligonucleotide
gguugggcagugaggagggu

SEQ ID NO: 2225 - RNA, 14 nt, Artificial Sequence
  synthetic oligonucleotide
cucacugcccaacc

SEQ ID NO: 2226 - RNA, 22 nt, Artificial Sequence
  synthetic oligonucleotide
uggaaaaaacuggugugugcuu

SEQ ID NO: 2227 - RNA, 20 nt, Artificial Sequence
  synthetic oligonucleotide
uggaaaaaacuggugugugc

SEQ ID NO: 2228 - RNA, 14 nt, Artificial Sequence
  synthetic oligonucleotide
accaguuuuuucca

SEQ ID NO: 2229 - RNA, 23 nt, Artificial Sequence
  synthetic oligonucleotide
uuuguauggauauguguguguau

SEQ ID NO: 2230 - RNA, 20 nt, Artificial Sequence
  synthetic oligonucleotide
uuuguauggauaugugugug

SEQ ID NO: 2231 - RNA, 14 nt, Artificial Sequence
  synthetic oligonucleotide
cauauccauacaaa

SEQ ID NO: 2232 - RNA, 22 nt, Artificial Sequence
  synthetic oligonucleotide
cuggggagauccucgagguugg

SEQ ID NO: 2233 - RNA, 20 nt, Artificial Sequence
  synthetic oligonucleotide
cuggggagauccucgagguu

SEQ ID NO: 2234 - RNA, 14 nt, Artificial Sequence
  synthetic oligonucleotide
gaggaucuccccag

SEQ ID NO: 2235 - RNA, 21 nt, Artificial Sequence
  synthetic oligonucleotide
ugaggagaucgucgagguugg

SEQ ID NO: 2236 - RNA, 20 nt, Artificial Sequence
  synthetic oligonucleotide
ugaggagaucgucgagguug

SEQ ID NO: 2237 - RNA, 14 nt, Artificial Sequence
  synthetic oligonucleotide
cgacgaucuccuca

SEQ ID NO: 2238 - RNA, 21 nt, Artificial Sequence
  synthetic oligonucleotide
gguggggcaaugggaucaggu

SEQ ID NO: 2239 - RNA, 20 nt, Artificial Sequence
  synthetic oligonucleotide
gguggggcaaugggaucagg

SEQ ID NO: 2240 - RNA, 14 nt, Artificial Sequence
  synthetic oligonucleotide
cccauugccccacc

SEQ ID NO: 2241 - RNA, 22 nt, Artificial Sequence
  synthetic oligonucleotide
uguguuagaauaggggcaauaa

SEQ ID NO: 2242 - RNA, 20 nt, Artificial Sequence
  synthetic oligonucleotide
uguguuagaauaggggcaau

SEQ ID NO: 2243 - RNA, 14 nt, Artificial Sequence
  synthetic oligonucleotide
ccuauucuaacaca

SEQ ID NO: 2244 - RNA, 23 nt, Artificial Sequence
  synthetic oligonucleotide
ggggaaagcgaguagggacauuu

SEQ ID NO: 2245 - RNA, 20 nt, Artificial Sequence
  synthetic oligonucleotide
ggggaaagcgaguagggaca

SEQ ID NO: 2246 - RNA, 14 nt, Artificial Sequence
  synthetic oligonucleotide
uacucgcuuucccc

SEQ ID NO: 2247 - RNA, 22 nt, Artificial Sequence
  synthetic oligonucleotide
cagaaggggaguugggagcaga

SEQ ID NO: 2248 - RNA, 20 nt, Artificial Sequence
  synthetic oligonucleotide
cagaaggggaguugggagca

SEQ ID NO: 2249 - RNA, 14 nt, Artificial Sequence
  synthetic oligonucleotide
caacuccccuucug

SEQ ID NO: 2250 - RNA, 21 nt, Artificial Sequence
  synthetic oligonucleotide
ccaggcucugcagugggaacu

SEQ ID NO: 2251 - RNA, 20 nt, Artificial Sequence
  synthetic oligonucleotide
ccaggcucugcagugggaac

SEQ ID NO: 2252 - RNA, 14 nt, Artificial Sequence
  synthetic oligonucleotide
acugcagagccugg

SEQ ID NO: 2253 - RNA, 22 nt, Artificial Sequence
  synthetic oligonucleotide
aaagaucuggaagugggagaca

SEQ ID NO: 2254 - RNA, 20 nt, Artificial Sequence
  synthetic oligonucleotide
aaagaucuggaagugggaga

SEQ ID NO: 2255 - RNA, 14 nt, Artificial Sequence
  synthetic oligonucleotide
acuuccagaucuuu

SEQ ID NO: 2256 - RNA, 22 nt, Artificial Sequence
  synthetic oligonucleotide
uucagccaggcuagugcagucu

SEQ ID NO: 2257 - RNA, 20 nt, Artificial Sequence
  synthetic oligonucleotide
uucagccaggcuagugcagu

SEQ ID NO: 2258 - RNA, 14 nt, Artificial Sequence
  synthetic oligonucleotide
cuagccuggcugaa

SEQ ID NO: 2259 - RNA, 22 nt, Artificial Sequence
  synthetic oligonucleotide
aagggcuuccucucugcaggac

SEQ ID NO: 2260 - RNA, 20 nt, Artificial Sequence
  synthetic oligonucleotide
aagggcuuccucucugcagg

SEQ ID NO: 2261 - RNA, 14 nt, Artificial Sequence
  synthetic oligonucleotide
gagaggaagcccuu

SEQ ID NO: 2262 - RNA, 22 nt, Artificial Sequence
  synthetic oligonucleotide
uaggauuacaagugucggccac

SEQ ID NO: 2263 - RNA, 20 nt, Artificial Sequence
  synthetic oligonucleotide
uaggauuacaagugucggcc

SEQ ID NO: 2264 - RNA, 14 nt, Artificial Sequence
  synthetic oligonucleotide
cacuuguaauccua

SEQ ID NO: 2265 - RNA, 22 nt, Artificial Sequence
  synthetic oligonucleotide
agagcugagacuagaaagccca

SEQ ID NO: 2266 - RNA, 20 nt, Artificial Sequence
  synthetic oligonucleotide
agagcugagacuagaaagcc

SEQ ID NO: 2267 - RNA, 14 nt, Artificial Sequence
  synthetic oligonucleotide
cuagucucagcucu

SEQ ID NO: 2268 - RNA, 23 nt, Artificial Sequence
  synthetic oligonucleotide
cugauaagaacagaggcccagau

SEQ ID NO: 2269 - RNA, 20 nt, Artificial Sequence
  synthetic oligonucleotide
cugauaagaacagaggccca

SEQ ID NO: 2270 - RNA, 14 nt, Artificial Sequence
  synthetic oligonucleotide
ucuguucuuaucag

SEQ ID NO: 2271 - RNA, 23 nt, Artificial Sequence
  synthetic oligonucleotide
uuagggaguagaaggguggggag

SEQ ID NO: 2272 - RNA, 20 nt, Artificial Sequence
  synthetic oligonucleotide
uuagggaguagaaggguggg

SEQ ID NO: 2273 - RNA, 14 nt, Artificial Sequence
  synthetic oligonucleotide
cuucuacucccuaa

SEQ ID NO: 2274 - RNA, 22 nt, Artificial Sequence
  synthetic oligonucleotide
uauaaaaugagggcaguaagac

SEQ ID NO: 2275 - RNA, 20 nt, Artificial Sequence
  synthetic oligonucleotide
uauaaaaugagggcaguaag

SEQ ID NO: 2276 - RNA, 14 nt, Artificial Sequence
  synthetic oligonucleotide
gcccucauuuuaua

SEQ ID NO: 2277 - RNA, 22 nt, Artificial Sequence
  synthetic oligonucleotide
ugugacuuuaagggaaauggcg

SEQ ID NO: 2278 - RNA, 20 nt, Artificial Sequence
  synthetic oligonucleotide
ugugacuuuaagggaaaugg

SEQ ID NO: 2279 - RNA, 14 nt, Artificial Sequence
  synthetic oligonucleotide
cccuuaaagucaca

SEQ ID NO: 2280 - RNA, 22 nt, Artificial Sequence
  synthetic oligonucleotide
agguggaugcaaugugaccuca

SEQ ID NO: 2281 - RNA, 20 nt, Artificial Sequence
  synthetic oligonucleotide
agguggaugcaaugugaccu

SEQ ID NO: 2282 - RNA, 14 nt, Artificial Sequence
  synthetic oligonucleotide
cauugcauccaccu

SEQ ID NO: 2283 - RNA, 23 nt, Artificial Sequence
  synthetic oligonucleotide
cgcagacaaugccuacuggccua

SEQ ID NO: 2284 - RNA, 20 nt, Artificial Sequence
  synthetic oligonucleotide
cgcagacaaugccuacuggc

SEQ ID NO: 2285 - RNA, 14 nt, Artificial Sequence
  synthetic oligonucleotide
aggcauugucugcg

SEQ ID NO: 2286 - RNA, 22 nt, Artificial Sequence
  synthetic oligonucleotide
aggauuucagaaauacuggugu

SEQ ID NO: 2287 - RNA, 20 nt, Artificial Sequence
  synthetic oligonucleotide
aggauuucagaaauacuggu

SEQ ID NO: 2288 - RNA, 14 nt, Artificial Sequence
  synthetic oligonucleotide
auuucugaaauccu

SEQ ID NO: 2289 - RNA, 17 nt, Artificial Sequence
  synthetic oligonucleotide
gaguucuacagucagac

SEQ ID NO: 2290 - RNA, 17 nt, Artificial Sequence
  synthetic oligonucleotide
gaguucuacagucagac

SEQ ID NO: 2291 - RNA, 14 nt, Artificial Sequence
  synthetic oligonucleotide
ugacuguagaacuc

SEQ ID NO: 2292 - RNA, 22 nt, Artificial Sequence
  synthetic oligonucleotide
uaggacugugcuuggcacauag

SEQ ID NO: 2293 - RNA, 20 nt, Artificial Sequence
  synthetic oligonucleotide
uaggacugugcuuggcacau

SEQ ID NO: 2294 - RNA, 14 nt, Artificial Sequence
  synthetic oligonucleotide
caagcacaguccua

SEQ ID NO: 2295 - RNA, 22 nt, Artificial Sequence
  synthetic oligonucleotide
cugggguucugagacagacagu

SEQ ID NO: 2296 - RNA, 20 nt, Artificial Sequence
  synthetic oligonucleotide
cugggguucugagacagaca

SEQ ID NO: 2297 - RNA, 14 nt, Artificial Sequence
  synthetic oligonucleotide
ucucagaaccccag

SEQ ID NO: 2298 - RNA, 24 nt, Artificial Sequence
  synthetic oligonucleotide
agauguauggaaucuguauauauc

SEQ ID NO: 2299 - RNA, 20 nt, Artificial Sequence
  synthetic oligonucleotide
agauguauggaaucuguaua

SEQ ID NO: 2300 - RNA, 14 nt, Artificial Sequence
  synthetic oligonucleotide
gauuccauacaucu

SEQ ID NO: 2301 - RNA, 22 nt, Artificial Sequence
  synthetic oligonucleotide
aaaggaggaaauaggcaggcca

SEQ ID NO: 2302 - RNA, 20 nt, Artificial Sequence
  synthetic oligonucleotide
aaaggaggaaauaggcaggc

SEQ ID NO: 2303 - RNA, 14 nt, Artificial Sequence
  synthetic oligonucleotide
cuauuuccuccuuu

SEQ ID NO: 2304 - RNA, 23 nt, Artificial Sequence
  synthetic oligonucleotide
uagugaguuagagaugcagagcc

SEQ ID NO: 2305 - RNA, 20 nt, Artificial Sequence
  synthetic oligonucleotide
uagugaguuagagaugcaga

SEQ ID NO: 2306 - RNA, 14 nt, Artificial Sequence
  synthetic oligonucleotide
ucucuaacucacua

SEQ ID NO: 2307 - RNA, 22 nt, Artificial Sequence
  synthetic oligonucleotide
cggggagagaacgcagugacgu

SEQ ID NO: 2308 - RNA, 20 nt, Artificial Sequence
  synthetic oligonucleotide
cggggagagaacgcagugac

SEQ ID NO: 2309 - RNA, 14 nt, Artificial Sequence
  synthetic oligonucleotide
gcguucucuccccg

SEQ ID NO: 2310 - RNA, 19 nt, Artificial Sequence
  synthetic oligonucleotide
acuggccugggacuaccgg

SEQ ID NO: 2311 - RNA, 19 nt, Artificial Sequence
  synthetic oligonucleotide
acuggccugggacuaccgg

SEQ ID NO: 2312 - RNA, 14 nt, Artificial Sequence
  synthetic oligonucleotide
agucccaggccagu

SEQ ID NO: 2313 - RNA, 21 nt, Artificial Sequence
  synthetic oligonucleotide
ugcacggcacuggggacacgu

SEQ ID NO: 2314 - RNA, 20 nt, Artificial Sequence
  synthetic oligonucleotide
ugcacggcacuggggacacg

SEQ ID NO: 2315 - RNA, 14 nt, Artificial Sequence
  synthetic oligonucleotide
cccagugccgugca

SEQ ID NO: 2316 - RNA, 17 nt, Artificial Sequence
  synthetic oligonucleotide
ggggcgcggccggaucg

SEQ ID NO: 2317 - RNA, 17 nt, Artificial Sequence
  synthetic oligonucleotide
ggggcgcggccggaucg

SEQ ID NO: 2318 - RNA, 14 nt, Artificial Sequence
  synthetic oligonucleotide
uccggccgcgcccc

SEQ ID NO: 2319 - RNA, 22 nt, Artificial Sequence
  synthetic oligonucleotide
agaaggggugaaauuuaaacgu

SEQ ID NO: 2320 - RNA, 20 nt, Artificial Sequence
  synthetic oligonucleotide
agaaggggugaaauuuaaac

SEQ ID NO: 2321 - RNA, 14 nt, Artificial Sequence
  synthetic oligonucleotide
auuucaccccuucu

SEQ ID NO: 2322 - RNA, 19 nt, Artificial Sequence
  synthetic oligonucleotide
uggggcggagcuuccggag

SEQ ID NO: 2323 - RNA, 19 nt, Artificial Sequence
  synthetic oligonucleotide
uggggcggagcuuccggag

SEQ ID NO: 2324 - RNA, 14 nt, Artificial Sequence
  synthetic oligonucleotide
gaagcuccgcccca

SEQ ID NO: 2325 - RNA, 22 nt, Artificial Sequence
  synthetic oligonucleotide
uggggcggagcuuccggaggcc

SEQ ID NO: 2326 - RNA, 20 nt, Artificial Sequence
  synthetic oligonucleotide
uggggcggagcuuccggagg

SEQ ID NO: 2327 - RNA, 14 nt, Artificial Sequence
  synthetic oligonucleotide
gaagcuccgcccca

SEQ ID NO: 2328 - RNA, 25 nt, Artificial Sequence
  synthetic oligonucleotide
cuuccagacgcuccgccccacgucg

SEQ ID NO: 2329 - RNA, 20 nt, Artificial Sequence
  synthetic oligonucleotide
cuuccagacgcuccgcccca

SEQ ID NO: 2330 - RNA, 14 nt, Artificial Sequence
  synthetic oligonucleotide
ggagcgucuggaag

SEQ ID NO: 2331 - RNA, 19 nt, Artificial Sequence
  synthetic oligonucleotide
aucgggcccucggcgccgg

SEQ ID NO: 2332 - RNA, 19 nt, Artificial Sequence
  synthetic oligonucleotide
aucgggcccucggcgccgg

SEQ ID NO: 2333 - RNA, 14 nt, Artificial Sequence
  synthetic oligonucleotide
gccgagggcccgau

SEQ ID NO: 2334 - RNA, 17 nt, Artificial Sequence
  synthetic oligonucleotide
gcuucuguaguguaguc

SEQ ID NO: 2335 - RNA, 17 nt, Artificial Sequence
  synthetic oligonucleotide
gcuucuguaguguaguc

SEQ ID NO: 2336 - RNA, 14 nt, Artificial Sequence
  synthetic oligonucleotide
uacacuacagaagc

SEQ ID NO: 2337 - RNA, 22 nt, Artificial Sequence
  synthetic oligonucleotide
gccucucucggagucgcucgga

SEQ ID NO: 2338 - RNA, 20 nt, Artificial Sequence
  synthetic oligonucleotide
gccucucucggagucgcucg

SEQ ID NO: 2339 - RNA, 14 nt, Artificial Sequence
  synthetic oligonucleotide
acuccgagagaggc

SEQ ID NO: 2340 - RNA, 24 nt, Artificial Sequence
  synthetic oligonucleotide
ugaggggccucagaccgagcuuuu

SEQ ID NO: 2341 - RNA, 20 nt, Artificial Sequence
  synthetic oligonucleotide
ugaggggccucagaccgagc

SEQ ID NO: 2342 - RNA, 14 nt, Artificial Sequence
  synthetic oligonucleotide
ucugaggccccuca

SEQ ID NO: 2343 - RNA, 23 nt, Artificial Sequence
  synthetic oligonucleotide
agaagaaggcggucggucugcgg

SEQ ID NO: 2344 - RNA, 20 nt, Artificial Sequence
  synthetic oligonucleotide
agaagaaggcggucggucug

SEQ ID NO: 2345 - RNA, 14 nt, Artificial Sequence
  synthetic oligonucleotide
gaccgccuucuucu

SEQ ID NO: 2346 - RNA, 21 nt, Artificial Sequence
  synthetic oligonucleotide
ucacgcggagagauggcuuug

SEQ ID NO: 2347 - RNA, 20 nt, Artificial Sequence
  synthetic oligonucleotide
ucacgcggagagauggcuuu

SEQ ID NO: 2348 - RNA, 14 nt, Artificial Sequence
  synthetic oligonucleotide
aucucuccgcguga

SEQ ID NO: 2349 - RNA, 22 nt, Artificial Sequence
  synthetic oligonucleotide
caggcgucugucuacguggcuu

SEQ ID NO: 2350 - RNA, 20 nt, Artificial Sequence
  synthetic oligonucleotide
caggcgucugucuacguggc

SEQ ID NO: 2351 - RNA, 14 nt, Artificial Sequence
  synthetic oligonucleotide
uagacagacgccug

SEQ ID NO: 2352 - RNA, 20 nt, Artificial Sequence
  synthetic oligonucleotide
uuggccauggggcugcgcgg

SEQ ID NO: 2353 - RNA, 20 nt, Artificial Sequence
  synthetic oligonucleotide
uuggccauggggcugcgcgg

SEQ ID NO: 2354 - RNA, 14 nt, Artificial Sequence
  synthetic oligonucleotide
agccccauggccaa

SEQ ID NO: 2355 - RNA, 23 nt, Artificial Sequence
  synthetic oligonucleotide
agaggcuuugugcggauacgggg

SEQ ID NO: 2356 - RNA, 20 nt, Artificial Sequence
  synthetic oligonucleotide
agaggcuuugugcggauacg

SEQ ID NO: 2357 - RNA, 14 nt, Artificial Sequence
  synthetic oligonucleotide
cgcacaaagccucu

SEQ ID NO: 2358 - RNA, 21 nt, Artificial Sequence
  synthetic oligonucleotide
cccuugggucugaugggguag

SEQ ID NO: 2359 - RNA, 20 nt, Artificial Sequence
  synthetic oligonucleotide
cccuugggucugauggggua

SEQ ID NO: 2360 - RNA, 14 nt, Artificial Sequence
  synthetic oligonucleotide
aucagacccaaggg

SEQ ID NO: 2361 - RNA, 23 nt, Artificial Sequence
  synthetic oligonucleotide
uguggaagguagacggccagaga

SEQ ID NO: 2362 - RNA, 20 nt, Artificial Sequence
  synthetic oligonucleotide
uguggaagguagacggccag

SEQ ID NO: 2363 - RNA, 14 nt, Artificial Sequence
  synthetic oligonucleotide
gucuaccuuccaca

SEQ ID NO: 2364 - RNA, 23 nt, Artificial Sequence
  synthetic oligonucleotide
uggggacguagcuggccagacag

SEQ ID NO: 2365 - RNA, 20 nt, Artificial Sequence
  synthetic oligonucleotide
uggggacguagcuggccaga

SEQ ID NO: 2366 - RNA, 14 nt, Artificial Sequence
  synthetic oligonucleotide
cagcuacgucccca

SEQ ID NO: 2367 - RNA, 23 nt, Artificial Sequence
  synthetic oligonucleotide
ucugggagguuguagcaguggaa

SEQ ID NO: 2368 - RNA, 20 nt, Artificial Sequence
  synthetic oligonucleotide
ucugggagguuguagcagug

SEQ ID NO: 2369 - RNA, 14 nt, Artificial Sequence
  synthetic oligonucleotide
uacaaccucccaga

SEQ ID NO: 2370 - RNA, 22 nt, Artificial Sequence
  synthetic oligonucleotide
uccugcguaggaucugaggagu

SEQ ID NO: 2371 - RNA, 20 nt, Artificial Sequence
  synthetic oligonucleotide
uccugcguaggaucugagga

SEQ ID NO: 2372 - RNA, 14 nt, Artificial Sequence
  synthetic oligonucleotide
gauccuacgcagga

SEQ ID NO: 2373 - RNA, 21 nt, Artificial Sequence
  synthetic oligonucleotide
ggccagccaccaggagggcug

SEQ ID NO: 2374 - RNA, 20 nt, Artificial Sequence
  synthetic oligonucleotide
ggccagccaccaggagggcu

SEQ ID NO: 2375 - RNA, 14 nt, Artificial Sequence
  synthetic oligonucleotide
ccugguggcuggcc

SEQ ID NO: 2376 - RNA, 17 nt, Artificial Sequence
  synthetic oligonucleotide
cgcgccgggcccggguu

SEQ ID NO: 2377 - RNA, 17 nt, Artificial Sequence
  synthetic oligonucleotide
cgcgccgggcccggguu

SEQ ID NO: 2378 - RNA, 14 nt, Artificial Sequence
  synthetic oligonucleotide
ccgggcccggcgcg

SEQ ID NO: 2379 - RNA, 18 nt, Artificial Sequence
  synthetic oligonucleotide
cggggcggcaggggccuc

SEQ ID NO: 2380 - RNA, 18 nt, Artificial Sequence
  synthetic oligonucleotide
cggggcggcaggggccuc

SEQ ID NO: 2381 - RNA, 14 nt, Artificial Sequence
  synthetic oligonucleotide
ccccugccgccccg

SEQ ID NO: 2382 - RNA, 23 nt, Artificial Sequence
  synthetic oligonucleotide
ggaggcgcaggcucggaaaggcg

SEQ ID NO: 2383 - RNA, 20 nt, Artificial Sequence
  synthetic oligonucleotide
ggaggcgcaggcucggaaag

SEQ ID NO: 2384 - RNA, 14 nt, Artificial Sequence
  synthetic oligonucleotide
gagccugcgccucc

SEQ ID NO: 2385 - RNA, 22 nt, Artificial Sequence
  synthetic oligonucleotide
guggaguccuggggaauggaga

SEQ ID NO: 2386 - RNA, 20 nt, Artificial Sequence
  synthetic oligonucleotide
guggaguccuggggaaugga

SEQ ID NO: 2387 - RNA, 14 nt, Artificial Sequence
  synthetic oligonucleotide
ccccaggacuccac

SEQ ID NO: 2388 - RNA, 23 nt, Artificial Sequence
  synthetic oligonucleotide
agggacugccuuaggagaaaguu

SEQ ID NO: 2389 - RNA, 20 nt, Artificial Sequence
  synthetic oligonucleotide
agggacugccuuaggagaaa

SEQ ID NO: 2390 - RNA, 14 nt, Artificial Sequence
  synthetic oligonucleotide
cuaaggcagucccu

SEQ ID NO: 2391 - RNA, 22 nt, Artificial Sequence
  synthetic oligonucleotide
uauugcacauuacuaaguugca

SEQ ID NO: 2392 - RNA, 20 nt, Artificial Sequence
  synthetic oligonucleotide
uauugcacauuacuaaguug

SEQ ID NO: 2393 - RNA, 14 nt, Artificial Sequence
  synthetic oligonucleotide
aguaaugugcaaua

SEQ ID NO: 2394 - RNA, 22 nt, Artificial Sequence
  synthetic oligonucleotide
caauuuagugugugugauauuu

SEQ ID NO: 2395 - RNA, 20 nt, Artificial Sequence
  synthetic oligonucleotide
caauuuagugugugugauau

SEQ ID NO: 2396 - RNA, 14 nt, Artificial Sequence
  synthetic oligonucleotide
cacacacuaaauug

SEQ ID NO: 2397 - RNA, 22 nt, Artificial Sequence
  synthetic oligonucleotide
caccuugcgcuacucaggucug

SEQ ID NO: 2398 - RNA, 20 nt, Artificial Sequence
  synthetic oligonucleotide
caccuugcgcuacucagguc

SEQ ID NO: 2399 - RNA, 14 nt, Artificial Sequence
  synthetic oligonucleotide
aguagcgcaaggug

SEQ ID NO: 2400 - RNA, 22 nt, Artificial Sequence
  synthetic oligonucleotide
aaucugagaaggcgcacaaggu

SEQ ID NO: 2401 - RNA, 20 nt, Artificial Sequence
  synthetic oligonucleotide
aaucugagaaggcgcacaag

SEQ ID NO: 2402 - RNA, 14 nt, Artificial Sequence
  synthetic oligonucleotide
cgccuucucagauu

SEQ ID NO: 2403 - RNA, 17 nt, Artificial Sequence
  synthetic oligonucleotide
gggauaugaagaaaaau

SEQ ID NO: 2404 - RNA, 17 nt, Artificial Sequence
  synthetic oligonucleotide
gggauaugaagaaaaau

SEQ ID NO: 2405 - RNA, 14 nt, Artificial Sequence
  synthetic oligonucleotide
uuucuucauauccc

SEQ ID NO: 2406 - RNA, 22 nt, Artificial Sequence
  synthetic oligonucleotide
uggaagggagaagagcuuuaau

SEQ ID NO: 2407 - RNA, 20 nt, Artificial Sequence
  synthetic oligonucleotide
uggaagggagaagagcuuua

SEQ ID NO: 2408 - RNA, 14 nt, Artificial Sequence
  synthetic oligonucleotide
ucuucucccuucca

SEQ ID NO: 2409 - RNA, 22 nt, Artificial Sequence
  synthetic oligonucleotide
aaaagcuggguugagagggcga

SEQ ID NO: 2410 - RNA, 20 nt, Artificial Sequence
  synthetic oligonucleotide
aaaagcuggguugagagggc

SEQ ID NO: 2411 - RNA, 14 nt, Artificial Sequence
  synthetic oligonucleotide
ucaacccagcuuuu

SEQ ID NO: 2412 - RNA, 22 nt, Artificial Sequence
  synthetic oligonucleotide
aaaagcuggguugagagggcaa

SEQ ID NO: 2413 - RNA, 20 nt, Artificial Sequence
  synthetic oligonucleotide
aaaagcuggguugagagggc

SEQ ID NO: 2414 - RNA, 14 nt, Artificial Sequence
  synthetic oligonucleotide
ucaacccagcuuuu

SEQ ID NO: 2415 - RNA, 20 nt, Artificial Sequence
  synthetic oligonucleotide
aaaagcuggguugagagggu

SEQ ID NO: 2416 - RNA, 20 nt, Artificial Sequence
  synthetic oligonucleotide
aaaagcuggguugagagggu

SEQ ID NO: 2417 - RNA, 14 nt, Artificial Sequence
  synthetic oligonucleotide
ucaacccagcuuuu

SEQ ID NO: 2418 - RNA, 19 nt, Artificial Sequence
  synthetic oligonucleotide
aaaagcuggguugagagga

SEQ ID NO: 2419 - RNA, 19 nt, Artificial Sequence
  synthetic oligonucleotide
aaaagcuggguugagagga

SEQ ID NO: 2420 - RNA, 14 nt, Artificial Sequence
  synthetic oligonucleotide
ucaacccagcuuuu

SEQ ID NO: 2421 - RNA, 18 nt, Artificial Sequence
  synthetic oligonucleotide
aaagcuggguugagaagg

SEQ ID NO: 2422 - RNA, 18 nt, Artificial Sequence
  synthetic oligonucleotide
aaagcuggguugagaagg

SEQ ID NO: 2423 - RNA, 14 nt, Artificial Sequence
  synthetic oligonucleotide
cucaacccagcuuu

SEQ ID NO: 2424 - RNA, 21 nt, Artificial Sequence
  synthetic oligonucleotide
cacauuacacggucgaccucu

SEQ ID NO: 2425 - RNA, 20 nt, Artificial Sequence
  synthetic oligonucleotide
cacauuacacggucgaccuc

SEQ ID NO: 2426 - RNA, 14 nt, Artificial Sequence
  synthetic oligonucleotide
gaccguguaaugug

SEQ ID NO: 2427 - RNA, 22 nt, Artificial Sequence
  synthetic oligonucleotide
aggugguccguggcgcguucgc

SEQ ID NO: 2428 - RNA, 20 nt, Artificial Sequence
  synthetic oligonucleotide
aggugguccguggcgcguuc

SEQ ID NO: 2429 - RNA, 14 nt, Artificial Sequence
  synthetic oligonucleotide
gccacggaccaccu

SEQ ID NO: 2430 - RNA, 22 nt, Artificial Sequence
  synthetic oligonucleotide
cccaauacacggucgaccucuu

SEQ ID NO: 2431 - RNA, 20 nt, Artificial Sequence
  synthetic oligonucleotide
cccaauacacggucgaccuc

SEQ ID NO: 2432 - RNA, 14 nt, Artificial Sequence
  synthetic oligonucleotide
gaccguguauuggg

SEQ ID NO: 2433 - RNA, 23 nt, Artificial Sequence
  synthetic oligonucleotide
agguuguccguggugaguucgca

SEQ ID NO: 2434 - RNA, 20 nt, Artificial Sequence
  synthetic oligonucleotide
agguuguccguggugaguuc

SEQ ID NO: 2435 - RNA, 14 nt, Artificial Sequence
  synthetic oligonucleotide
accacggacaaccu

SEQ ID NO: 2436 - RNA, 20 nt, Artificial Sequence
  synthetic oligonucleotide
acugccccaggugcugcugg

SEQ ID NO: 2437 - RNA, 20 nt, Artificial Sequence
  synthetic oligonucleotide
acugccccaggugcugcugg

SEQ ID NO: 2438 - RNA, 14 nt, Artificial Sequence
  synthetic oligonucleotide
gcaccuggggcagu

SEQ ID NO: 2439 - RNA, 23 nt, Artificial Sequence
  synthetic oligonucleotide
cgcauccccuagggcauuggugu

SEQ ID NO: 2440 - RNA, 20 nt, Artificial Sequence
  synthetic oligonucleotide
cgcauccccuagggcauugg

SEQ ID NO: 2441 - RNA, 14 nt, Artificial Sequence
  synthetic oligonucleotide
cccuaggggaugcg

SEQ ID NO: 2442 - RNA, 23 nt, Artificial Sequence
  synthetic oligonucleotide
ccuaguagguguccaguaagugu

SEQ ID NO: 2443 - RNA, 20 nt, Artificial Sequence
  synthetic oligonucleotide
ccuaguagguguccaguaag

SEQ ID NO: 2444 - RNA, 14 nt, Artificial Sequence
  synthetic oligonucleotide
ggacaccuacuagg

SEQ ID NO: 2445 - RNA, 20 nt, Artificial Sequence
  synthetic oligonucleotide
ccucugggcccuuccuccag

SEQ ID NO: 2446 - RNA, 20 nt, Artificial Sequence
  synthetic oligonucleotide
ccucugggcccuuccuccag

SEQ ID NO: 2447 - RNA, 14 nt, Artificial Sequence
  synthetic oligonucleotide
gaagggcccagagg

SEQ ID NO: 2448 - RNA, 22 nt, Artificial Sequence
  synthetic oligonucleotide
cuggcccucucugcccuuccgu

SEQ ID NO: 2449 - RNA, 20 nt, Artificial Sequence
  synthetic oligonucleotide
cuggcccucucugcccuucc

SEQ ID NO: 2450 - RNA, 14 nt, Artificial Sequence
  synthetic oligonucleotide
gcagagagggccag

SEQ ID NO: 2451 - RNA, 22 nt, Artificial Sequence
  synthetic oligonucleotide
aacacaccugguuaaccucuuu

SEQ ID NO: 2452 - RNA, 20 nt, Artificial Sequence
  synthetic oligonucleotide
aacacaccugguuaaccucu

SEQ ID NO: 2453 - RNA, 14 nt, Artificial Sequence
  synthetic oligonucleotide
uaaccagguguguu

SEQ ID NO: 2454 - RNA, 23 nt, Artificial Sequence
  synthetic oligonucleotide
gcaaagcacacggccugcagaga

SEQ ID NO: 2455 - RNA, 20 nt, Artificial Sequence
  synthetic oligonucleotide
gcaaagcacacggccugcag

SEQ ID NO: 2456 - RNA, 14 nt, Artificial Sequence
  synthetic oligonucleotide
gccgugugcuuugc

SEQ ID NO: 2457 - RNA, 22 nt, Artificial Sequence
  synthetic oligonucleotide
ucucugggccugugucuuaggc

SEQ ID NO: 2458 - RNA, 20 nt, Artificial Sequence
  synthetic oligonucleotide
ucucugggccugugucuuag

SEQ ID NO: 2459 - RNA, 14 nt, Artificial Sequence
  synthetic oligonucleotide
cacaggcccagaga

SEQ ID NO: 2460 - RNA, 21 nt, Artificial Sequence
  synthetic oligonucleotide
gccccugggccuauccuagaa

SEQ ID NO: 2461 - RNA, 20 nt, Artificial Sequence
  synthetic oligonucleotide
gccccugggccuauccuaga

SEQ ID NO: 2462 - RNA, 14 nt, Artificial Sequence
  synthetic oligonucleotide
auaggcccaggggc

SEQ ID NO: 2463 - RNA, 22 nt, Artificial Sequence
  synthetic oligonucleotide
cuagguauggucccagggaucc

SEQ ID NO: 2464 - RNA, 20 nt, Artificial Sequence
  synthetic oligonucleotide
cuagguauggucccagggau

SEQ ID NO: 2465 - RNA, 14 nt, Artificial Sequence
  synthetic oligonucleotide
gggaccauaccuag

SEQ ID NO: 2466 - RNA, 23 nt, Artificial Sequence
  synthetic oligonucleotide
ucaagagcaauaacgaaaaaugu

SEQ ID NO: 2467 - RNA, 20 nt, Artificial Sequence
  synthetic oligonucleotide
ucaagagcaauaacgaaaaa

SEQ ID NO: 2468 - RNA, 14 nt, Artificial Sequence
  synthetic oligonucleotide
guuauugcucuuga

SEQ ID NO: 2469 - RNA, 22 nt, Artificial Sequence
  synthetic oligonucleotide
uuuuucauuauugcuccugacc

SEQ ID NO: 2470 - RNA, 20 nt, Artificial Sequence
  synthetic oligonucleotide
uuuuucauuauugcuccuga

SEQ ID NO: 2471 - RNA, 14 nt, Artificial Sequence
  synthetic oligonucleotide
gcaauaaugaaaaa

SEQ ID NO: 2472 - RNA, 22 nt, Artificial Sequence
  synthetic oligonucleotide
cuccuauaugaugccuuucuuc

SEQ ID NO: 2473 - RNA, 20 nt, Artificial Sequence
  synthetic oligonucleotide
cuccuauaugaugccuuucu

SEQ ID NO: 2474 - RNA, 14 nt, Artificial Sequence
  synthetic oligonucleotide
gcaucauauaggag

SEQ ID NO: 2475 - RNA, 21 nt, Artificial Sequence
  synthetic oligonucleotide
gaacggcuucauacaggaguu

SEQ ID NO: 2476 - RNA, 20 nt, Artificial Sequence
  synthetic oligonucleotide
gaacggcuucauacaggagu

SEQ ID NO: 2477 - RNA, 14 nt, Artificial Sequence
  synthetic oligonucleotide
guaugaagccguuc

SEQ ID NO: 2478 - RNA, 22 nt, Artificial Sequence
  synthetic oligonucleotide
uccagcaucagugauuuuguug

SEQ ID NO: 2479 - RNA, 20 nt, Artificial Sequence
  synthetic oligonucleotide
uccagcaucagugauuuugu

SEQ ID NO: 2480 - RNA, 14 nt, Artificial Sequence
  synthetic oligonucleotide
ucacugaugcugga

SEQ ID NO: 2481 - RNA, 22 nt, Artificial Sequence
  synthetic oligonucleotide
aacaauauccuggugcugagug

SEQ ID NO: 2482 - RNA, 20 nt, Artificial Sequence
  synthetic oligonucleotide
aacaauauccuggugcugag

SEQ ID NO: 2483 - RNA, 14 nt, Artificial Sequence
  synthetic oligonucleotide
accaggauauuguu

SEQ ID NO: 2484 - RNA, 23 nt, Artificial Sequence
  synthetic oligonucleotide
ugagcgccucgacgacagagccg

SEQ ID NO: 2485 - RNA, 20 nt, Artificial Sequence
  synthetic oligonucleotide
ugagcgccucgacgacagag

SEQ ID NO: 2486 - RNA, 14 nt, Artificial Sequence
  synthetic oligonucleotide
cgucgaggcgcuca

SEQ ID NO: 2487 - RNA, 23 nt, Artificial Sequence
  synthetic oligonucleotide
ucccuguccuccaggagcucacg

SEQ ID NO: 2488 - RNA, 20 nt, Artificial Sequence
  synthetic oligonucleotide
ucccuguccuccaggagcuc

SEQ ID NO: 2489 - RNA, 14 nt, Artificial Sequence
  synthetic oligonucleotide
cuggaggacaggga

SEQ ID NO: 2490 - RNA, 21 nt, Artificial Sequence
  synthetic oligonucleotide
gugcauuguaguugcauugca

SEQ ID NO: 2491 - RNA, 20 nt, Artificial Sequence
  synthetic oligonucleotide
gugcauuguaguugcauugc

SEQ ID NO: 2492 - RNA, 14 nt, Artificial Sequence
  synthetic oligonucleotide
caacuacaaugcac

SEQ ID NO: 2493 - RNA, 22 nt, Artificial Sequence
  synthetic oligonucleotide
caauguuuccacagugcaucac

SEQ ID NO: 2494 - RNA, 20 nt, Artificial Sequence
  synthetic oligonucleotide
caauguuuccacagugcauc

SEQ ID NO: 2495 - RNA, 14 nt, Artificial Sequence
  synthetic oligonucleotide
cuguggaaacauug

SEQ ID NO: 2496 - RNA, 20 nt, Artificial Sequence
  synthetic oligonucleotide
gugcauugcuguugcauugc

SEQ ID NO: 2497 - RNA, 20 nt, Artificial Sequence
  synthetic oligonucleotide
gugcauugcuguugcauugc

SEQ ID NO: 2498 - RNA, 14 nt, Artificial Sequence
  synthetic oligonucleotide
caacagcaaugcac

SEQ ID NO: 2499 - RNA, 22 nt, Artificial Sequence
  synthetic oligonucleotide
cagugccucggcagugcagccc

SEQ ID NO: 2500 - RNA, 20 nt, Artificial Sequence
  synthetic oligonucleotide
cagugccucggcagugcagc

SEQ ID NO: 2501 - RNA, 14 nt, Artificial Sequence
  synthetic oligonucleotide
cugccgaggcacug

SEQ ID NO: 2502 - RNA, 22 nt, Artificial Sequence
  synthetic oligonucleotide
uuauaaagcaaugagacugauu

SEQ ID NO: 2503 - RNA, 20 nt, Artificial Sequence
  synthetic oligonucleotide
uuauaaagcaaugagacuga

SEQ ID NO: 2504 - RNA, 14 nt, Artificial Sequence
  synthetic oligonucleotide
ucauugcuuuauaa

SEQ ID NO: 2505 - RNA, 22 nt, Artificial Sequence
  synthetic oligonucleotide
uccgucucaguuacuuuauagc

SEQ ID NO: 2506 - RNA, 20 nt, Artificial Sequence
  synthetic oligonucleotide
uccgucucaguuacuuuaua

SEQ ID NO: 2507 - RNA, 14 nt, Artificial Sequence
  synthetic oligonucleotide
guaacugagacgga

SEQ ID NO: 2508 - RNA, 23 nt, Artificial Sequence
  synthetic oligonucleotide
ucucacacagaaaucgcacccgu

SEQ ID NO: 2509 - RNA, 20 nt, Artificial Sequence
  synthetic oligonucleotide
ucucacacagaaaucgcacc

SEQ ID NO: 2510 - RNA, 14 nt, Artificial Sequence
  synthetic oligonucleotide
auuucugugugaga

SEQ ID NO: 2511 - RNA, 21 nt, Artificial Sequence
  synthetic oligonucleotide
aggggugcuaucugugauuga

SEQ ID NO: 2512 - RNA, 20 nt, Artificial Sequence
  synthetic oligonucleotide
aggggugcuaucugugauug

SEQ ID NO: 2513 - RNA, 14 nt, Artificial Sequence
  synthetic oligonucleotide
cagauagcaccccu

SEQ ID NO: 2514 - RNA, 22 nt, Artificial Sequence
  synthetic oligonucleotide
gcugacuccuaguccagggcuc

SEQ ID NO: 2515 - RNA, 20 nt, Artificial Sequence
  synthetic oligonucleotide
gcugacuccuaguccagggc

SEQ ID NO: 2516 - RNA, 14 nt, Artificial Sequence
  synthetic oligonucleotide
gacuaggagucagc

SEQ ID NO: 2517 - RNA, 23 nt, Artificial Sequence
  synthetic oligonucleotide
ugucugcccgcaugccugccucu

SEQ ID NO: 2518 - RNA, 20 nt, Artificial Sequence
  synthetic oligonucleotide
ugucugcccgcaugccugcc

SEQ ID NO: 2519 - RNA, 14 nt, Artificial Sequence
  synthetic oligonucleotide
caugcgggcagaca

SEQ ID NO: 2520 - RNA, 22 nt, Artificial Sequence
  synthetic oligonucleotide
uggcagugucuuagcugguugu

SEQ ID NO: 2521 - RNA, 20 nt, Artificial Sequence
  synthetic oligonucleotide
uggcagugucuuagcugguu

SEQ ID NO: 2522 - RNA, 14 nt, Artificial Sequence
  synthetic oligonucleotide
cuaagacacugcca

SEQ ID NO: 2523 - RNA, 22 nt, Artificial Sequence
  synthetic oligonucleotide
caaucagcaaguauacugcccu

SEQ ID NO: 2524 - RNA, 20 nt, Artificial Sequence
  synthetic oligonucleotide
caaucagcaaguauacugcc

SEQ ID NO: 2525 - RNA, 14 nt, Artificial Sequence
  synthetic oligonucleotide
auacuugcugauug

SEQ ID NO: 2526 - RNA, 22 nt, Artificial Sequence
  synthetic oligonucleotide
caaucacuaacuccacugccau

SEQ ID NO: 2527 - RNA, 20 nt, Artificial Sequence
  synthetic oligonucleotide
caaucacuaacuccacugcc

SEQ ID NO: 2528 - RNA, 14 nt, Artificial Sequence
  synthetic oligonucleotide
ggaguuagugauug

SEQ ID NO: 2529 - RNA, 23 nt, Artificial Sequence
  synthetic oligonucleotide
uaggcagugucauuagcugauug

SEQ ID NO: 2530 - RNA, 20 nt, Artificial Sequence
  synthetic oligonucleotide
uaggcagugucauuagcuga

SEQ ID NO: 2531 - RNA, 14 nt, Artificial Sequence
  synthetic oligonucleotide
aaugacacugccua

SEQ ID NO: 2532 - RNA, 22 nt, Artificial Sequence
  synthetic oligonucleotide
aaucacuaaccacacggccagg

SEQ ID NO: 2533 - RNA, 20 nt, Artificial Sequence
  synthetic oligonucleotide
aaucacuaaccacacggcca

SEQ ID NO: 2534 - RNA, 14 nt, Artificial Sequence
  synthetic oligonucleotide
ugugguuagugauu

SEQ ID NO: 2535 - RNA, 23 nt, Artificial Sequence
  synthetic oligonucleotide
aggcaguguaguuagcugauugc

SEQ ID NO: 2536 - RNA, 20 nt, Artificial Sequence
  synthetic oligonucleotide
aggcaguguaguuagcugau

SEQ ID NO: 2537 - RNA, 14 nt, Artificial Sequence
  synthetic oligonucleotide
uaacuacacugccu

SEQ ID NO: 2538 - RNA, 23 nt, Artificial Sequence
  synthetic oligonucleotide
ccuccguguuaccuguccucuag

SEQ ID NO: 2539 - RNA, 20 nt, Artificial Sequence
  synthetic oligonucleotide
ccuccguguuaccuguccuc

SEQ ID NO: 2540 - RNA, 14 nt, Artificial Sequence
  synthetic oligonucleotide
agguaacacggagg

SEQ ID NO: 2541 - RNA, 23 nt, Artificial Sequence
  synthetic oligonucleotide
ugaggauggauagcaaggaagcc

SEQ ID NO: 2542 - RNA, 20 nt, Artificial Sequence
  synthetic oligonucleotide
ugaggauggauagcaaggaa

SEQ ID NO: 2543 - RNA, 14 nt, Artificial Sequence
  synthetic oligonucleotide
gcuauccauccuca

SEQ ID NO: 2544 - RNA, 21 nt, Artificial Sequence
  synthetic oligonucleotide
uuagugaaggcuauuuuaauu

SEQ ID NO: 2545 - RNA, 20 nt, Artificial Sequence
  synthetic oligonucleotide
uuagugaaggcuauuuuaau

SEQ ID NO: 2546 - RNA, 14 nt, Artificial Sequence
  synthetic oligonucleotide
auagccuucacuaa

SEQ ID NO: 2547 - RNA, 20 nt, Artificial Sequence
  synthetic oligonucleotide
acuguaaacgcuuucugaug

SEQ ID NO: 2548 - RNA, 20 nt, Artificial Sequence
  synthetic oligonucleotide
acuguaaacgcuuucugaug

SEQ ID NO: 2549 - RNA, 14 nt, Artificial Sequence
  synthetic oligonucleotide
aaagcguuuacagu

SEQ ID NO: 2550 - RNA, 22 nt, Artificial Sequence
  synthetic oligonucleotide
gcaugugaugaagcaaaucagu

SEQ ID NO: 2551 - RNA, 20 nt, Artificial Sequence
  synthetic oligonucleotide
gcaugugaugaagcaaauca

SEQ ID NO: 2552 - RNA, 14 nt, Artificial Sequence
  synthetic oligonucleotide
gcuucaucacaugc

SEQ ID NO: 2553 - RNA, 24 nt, Artificial Sequence
  synthetic oligonucleotide
caaagugaugaguaauacuggcug

SEQ ID NO: 2554 - RNA, 20 nt, Artificial Sequence
  synthetic oligonucleotide
caaagugaugaguaauacug

SEQ ID NO: 2555 - RNA, 14 nt, Artificial Sequence
  synthetic oligonucleotide
uacucaucacuuug

SEQ ID NO: 2556 - RNA, 20 nt, Artificial Sequence
  synthetic oligonucleotide
gaaucggaaaggaggcgccg

SEQ ID NO: 2557 - RNA, 20 nt, Artificial Sequence
  synthetic oligonucleotide
gaaucggaaaggaggcgccg

SEQ ID NO: 2558 - RNA, 14 nt, Artificial Sequence
  synthetic oligonucleotide
cuccuuuccgauuc

SEQ ID NO: 2559 - RNA, 21 nt, Artificial Sequence
  synthetic oligonucleotide
uugugaagaaagaaauucuua

SEQ ID NO: 2560 - RNA, 20 nt, Artificial Sequence
  synthetic oligonucleotide
uugugaagaaagaaauucuu

SEQ ID NO: 2561 - RNA, 14 nt, Artificial Sequence
  synthetic oligonucleotide
uucuuucuucacaa

SEQ ID NO: 2562 - RNA, 22 nt, Artificial Sequence
  synthetic oligonucleotide
aggaggcaucuugagaaaugga

SEQ ID NO: 2563 - RNA, 20 nt, Artificial Sequence
  synthetic oligonucleotide
aggaggcaucuugagaaaug

SEQ ID NO: 2564 - RNA, 14 nt, Artificial Sequence
  synthetic oligonucleotide
ucaagaugccuccu

SEQ ID NO: 2565 - RNA, 24 nt, Artificial Sequence
  synthetic oligonucleotide
acaaaaaaaaaagcccaacccuuc

SEQ ID NO: 2566 - RNA, 20 nt, Artificial Sequence
  synthetic oligonucleotide
acaaaaaaaaaagcccaacc

SEQ ID NO: 2567 - RNA, 14 nt, Artificial Sequence
  synthetic oligonucleotide
gcuuuuuuuuuugu

SEQ ID NO: 2568 - RNA, 22 nt, Artificial Sequence
  synthetic oligonucleotide
uguuguacuuuuuuuuuuguuc

SEQ ID NO: 2569 - RNA, 20 nt, Artificial Sequence
  synthetic oligonucleotide
uguuguacuuuuuuuuuugu

SEQ ID NO: 2570 - RNA, 14 nt, Artificial Sequence
  synthetic oligonucleotide
aaaaaaguacaaca

SEQ ID NO: 2571 - RNA, 23 nt, Artificial Sequence
  synthetic oligonucleotide
ucccccaggugugauucugauuu

SEQ ID NO: 2572 - RNA, 20 nt, Artificial Sequence
  synthetic oligonucleotide
ucccccaggugugauucuga

SEQ ID NO: 2573 - RNA, 14 nt, Artificial Sequence
  synthetic oligonucleotide
ucacaccuggggga

SEQ ID NO: 2574 - RNA, 23 nt, Artificial Sequence
  synthetic oligonucleotide
uagccuucagaucuugguguuuu

SEQ ID NO: 2575 - RNA, 20 nt, Artificial Sequence
  synthetic oligonucleotide
uagccuucagaucuuggugu

SEQ ID NO: 2576 - RNA, 14 nt, Artificial Sequence
  synthetic oligonucleotide
agaucugaaggcua

SEQ ID NO: 2577 - RNA, 23 nt, Artificial Sequence
  synthetic oligonucleotide
ccacuuggaucugaaggcugccc

SEQ ID NO: 2578 - RNA, 20 nt, Artificial Sequence
  synthetic oligonucleotide
ccacuuggaucugaaggcug

SEQ ID NO: 2579 - RNA, 14 nt, Artificial Sequence
  synthetic oligonucleotide
ucagauccaagugg

SEQ ID NO: 2580 - RNA, 21 nt, Artificial Sequence
  synthetic oligonucleotide
ucucucggcuccucgcggcuc

SEQ ID NO: 2581 - RNA, 20 nt, Artificial Sequence
  synthetic oligonucleotide
ucucucggcuccucgcggcu

SEQ ID NO: 2582 - RNA, 14 nt, Artificial Sequence
  synthetic oligonucleotide
gaggagccgagaga

SEQ ID NO: 2583 - RNA, 22 nt, Artificial Sequence
  synthetic oligonucleotide
uuaucagaaucuccagggguac

SEQ ID NO: 2584 - RNA, 20 nt, Artificial Sequence
  synthetic oligonucleotide
uuaucagaaucuccaggggu

SEQ ID NO: 2585 - RNA, 14 nt, Artificial Sequence
  synthetic oligonucleotide
ggagauucugauaa

SEQ ID NO: 2586 - RNA, 23 nt, Artificial Sequence
  synthetic oligonucleotide
cgagggcauuucaugaugcaggc

SEQ ID NO: 2587 - RNA, 20 nt, Artificial Sequence
  synthetic oligonucleotide
cgagggcauuucaugaugca

SEQ ID NO: 2588 - RNA, 14 nt, Artificial Sequence
  synthetic oligonucleotide
augaaaugcccucg

SEQ ID NO: 2589 - RNA, 22 nt, Artificial Sequence
  synthetic oligonucleotide
augaagugcacucaugauaugu

SEQ ID NO: 2590 - RNA, 20 nt, Artificial Sequence
  synthetic oligonucleotide
augaagugcacucaugauau

SEQ ID NO: 2591 - RNA, 14 nt, Artificial Sequence
  synthetic oligonucleotide
ugagugcacuucau

SEQ ID NO: 2592 - RNA, 22 nt, Artificial Sequence
  synthetic oligonucleotide
aaagacauaguugcaagauggg

SEQ ID NO: 2593 - RNA, 20 nt, Artificial Sequence
  synthetic oligonucleotide
aaagacauaguugcaagaug

SEQ ID NO: 2594 - RNA, 14 nt, Artificial Sequence
  synthetic oligonucleotide
gcaacuaugucuuu

SEQ ID NO: 2595 - RNA, 22 nt, Artificial Sequence
  synthetic oligonucleotide
ugucuacauuaaugaaaagagc

SEQ ID NO: 2596 - RNA, 20 nt, Artificial Sequence
  synthetic oligonucleotide
ugucuacauuaaugaaaaga

SEQ ID NO: 2597 - RNA, 14 nt, Artificial Sequence
  synthetic oligonucleotide
cauuaauguagaca

SEQ ID NO: 2598 - RNA, 22 nt, Artificial Sequence
  synthetic oligonucleotide
ucagcaggcaggcuggugcagc

SEQ ID NO: 2599 - RNA, 20 nt, Artificial Sequence
  synthetic oligonucleotide
ucagcaggcaggcuggugca

SEQ ID NO: 2600 - RNA, 14 nt, Artificial Sequence
  synthetic oligonucleotide
agccugccugcuga

SEQ ID NO: 2601 - RNA, 22 nt, Artificial Sequence
  synthetic oligonucleotide
ucacccugcaucccgcacccag

SEQ ID NO: 2602 - RNA, 20 nt, Artificial Sequence
  synthetic oligonucleotide
ucacccugcaucccgcaccc

SEQ ID NO: 2603 - RNA, 14 nt, Artificial Sequence
  synthetic oligonucleotide
gggaugcaggguga

SEQ ID NO: 2604 - RNA, 20 nt, Artificial Sequence
  synthetic oligonucleotide
cgcgggucggggucugcagg

SEQ ID NO: 2605 - RNA, 20 nt, Artificial Sequence
  synthetic oligonucleotide
cgcgggucggggucugcagg

SEQ ID NO: 2606 - RNA, 14 nt, Artificial Sequence
  synthetic oligonucleotide
gaccccgacccgcg

SEQ ID NO: 2607 - RNA, 22 nt, Artificial Sequence
  synthetic oligonucleotide
ucaccugaccucccaugccugu

SEQ ID NO: 2608 - RNA, 20 nt, Artificial Sequence
  synthetic oligonucleotide
ucaccugaccucccaugccu

SEQ ID NO: 2609 - RNA, 14 nt, Artificial Sequence
  synthetic oligonucleotide
gggaggucagguga

SEQ ID NO: 2610 - RNA, 22 nt, Artificial Sequence
  synthetic oligonucleotide
caggcacgggagcucaggugag

SEQ ID NO: 2611 - RNA, 20 nt, Artificial Sequence
  synthetic oligonucleotide
caggcacgggagcucaggug

SEQ ID NO: 2612 - RNA, 14 nt, Artificial Sequence
  synthetic oligonucleotide
agcucccgugccug

SEQ ID NO: 2613 - RNA, 21 nt, Artificial Sequence
  synthetic oligonucleotide
ucaccugagcucccgugccug

SEQ ID NO: 2614 - RNA, 20 nt, Artificial Sequence
  synthetic oligonucleotide
ucaccugagcucccgugccu

SEQ ID NO: 2615 - RNA, 14 nt, Artificial Sequence
  synthetic oligonucleotide
gggagcucagguga

SEQ ID NO: 2616 - RNA, 20 nt, Artificial Sequence
  synthetic oligonucleotide
aggcaugggaggucagguga

SEQ ID NO: 2617 - RNA, 20 nt, Artificial Sequence
  synthetic oligonucleotide
aggcaugggaggucagguga

SEQ ID NO: 2618 - RNA, 14 nt, Artificial Sequence
  synthetic oligonucleotide
gaccucccaugccu

SEQ ID NO: 2619 - RNA, 22 nt, Artificial Sequence
  synthetic oligonucleotide
aacacaccuauucaaggauuca

SEQ ID NO: 2620 - RNA, 20 nt, Artificial Sequence
  synthetic oligonucleotide
aacacaccuauucaaggauu

SEQ ID NO: 2621 - RNA, 14 nt, Artificial Sequence
  synthetic oligonucleotide
ugaauagguguguu

SEQ ID NO: 2622 - RNA, 24 nt, Artificial Sequence
  synthetic oligonucleotide
aauccuuggaaccuaggugugagu

SEQ ID NO: 2623 - RNA, 20 nt, Artificial Sequence
  synthetic oligonucleotide
aauccuuggaaccuaggugu

SEQ ID NO: 2624 - RNA, 14 nt, Artificial Sequence
  synthetic oligonucleotide
agguuccaaggauu

SEQ ID NO: 2625 - RNA, 22 nt, Artificial Sequence
  synthetic oligonucleotide
aauugcacgguauccaucugua

SEQ ID NO: 2626 - RNA, 20 nt, Artificial Sequence
  synthetic oligonucleotide
aauugcacgguauccaucug

SEQ ID NO: 2627 - RNA, 14 nt, Artificial Sequence
  synthetic oligonucleotide
gauaccgugcaauu

SEQ ID NO: 2628 - RNA, 22 nt, Artificial Sequence
  synthetic oligonucleotide
cggguggaucacgaugcaauuu

SEQ ID NO: 2629 - RNA, 20 nt, Artificial Sequence
  synthetic oligonucleotide
cggguggaucacgaugcaau

SEQ ID NO: 2630 - RNA, 14 nt, Artificial Sequence
  synthetic oligonucleotide
ucgugauccacccg

SEQ ID NO: 2631 - RNA, 22 nt, Artificial Sequence
  synthetic oligonucleotide
aaaaugaaaugagcccagccca

SEQ ID NO: 2632 - RNA, 20 nt, Artificial Sequence
  synthetic oligonucleotide
aaaaugaaaugagcccagcc

SEQ ID NO: 2633 - RNA, 14 nt, Artificial Sequence
  synthetic oligonucleotide
gcucauuucauuuu

SEQ ID NO: 2634 - RNA, 23 nt, Artificial Sequence
  synthetic oligonucleotide
agaaaauuuuugugugucugauc

SEQ ID NO: 2635 - RNA, 20 nt, Artificial Sequence
  synthetic oligonucleotide
agaaaauuuuugugugucug

SEQ ID NO: 2636 - RNA, 14 nt, Artificial Sequence
  synthetic oligonucleotide
cacaaaaauuuucu

SEQ ID NO: 2637 - RNA, 23 nt, Artificial Sequence
  synthetic oligonucleotide
cugaagugaugauucacauucau

SEQ ID NO: 2638 - RNA, 20 nt, Artificial Sequence
  synthetic oligonucleotide
cugaagugaugauucacauu

SEQ ID NO: 2639 - RNA, 14 nt, Artificial Sequence
  synthetic oligonucleotide
aaucaucacuucag

SEQ ID NO: 2640 - RNA, 21 nt, Artificial Sequence
  synthetic oligonucleotide
agccgcggggaucgccgaggg

SEQ ID NO: 2641 - RNA, 20 nt, Artificial Sequence
  synthetic oligonucleotide
agccgcggggaucgccgagg

SEQ ID NO: 2642 - RNA, 14 nt, Artificial Sequence
  synthetic oligonucleotide
cgauccccgcggcu

SEQ ID NO: 2643 - RNA, 19 nt, Artificial Sequence
  synthetic oligonucleotide
agggaccugagugucuaag

SEQ ID NO: 2644 - RNA, 19 nt, Artificial Sequence
  synthetic oligonucleotide
agggaccugagugucuaag

SEQ ID NO: 2645 - RNA, 14 nt, Artificial Sequence
  synthetic oligonucleotide
acacucaggucccu

SEQ ID NO: 2646 - RNA, 22 nt, Artificial Sequence
  synthetic oligonucleotide
uaaugccccuaaaaauccuuau

SEQ ID NO: 2647 - RNA, 20 nt, Artificial Sequence
  synthetic oligonucleotide
uaaugccccuaaaaauccuu

SEQ ID NO: 2648 - RNA, 14 nt, Artificial Sequence
  synthetic oligonucleotide
uuuuaggggcauua

SEQ ID NO: 2649 - RNA, 22 nt, Artificial Sequence
  synthetic oligonucleotide
agggacuuucaggggcagcugu

SEQ ID NO: 2650 - RNA, 20 nt, Artificial Sequence
  synthetic oligonucleotide
agggacuuucaggggcagcu

SEQ ID NO: 2651 - RNA, 14 nt, Artificial Sequence
  synthetic oligonucleotide
cccugaaagucccu

SEQ ID NO: 2652 - RNA, 19 nt, Artificial Sequence
  synthetic oligonucleotide
aggugugucuguagagucc

SEQ ID NO: 2653 - RNA, 19 nt, Artificial Sequence
  synthetic oligonucleotide
aggugugucuguagagucc

SEQ ID NO: 2654 - RNA, 14 nt, Artificial Sequence
  synthetic oligonucleotide
cuacagacacaccu

SEQ ID NO: 2655 - RNA, 24 nt, Artificial Sequence
  synthetic oligonucleotide
cauagcccggucgcugguacauga

SEQ ID NO: 2656 - RNA, 20 nt, Artificial Sequence
  synthetic oligonucleotide
cauagcccggucgcugguac

SEQ ID NO: 2657 - RNA, 14 nt, Artificial Sequence
  synthetic oligonucleotide
gcgaccgggcuaug

SEQ ID NO: 2658 - RNA, 18 nt, Artificial Sequence
  synthetic oligonucleotide
cggcuggaggugugagga

SEQ ID NO: 2659 - RNA, 18 nt, Artificial Sequence
  synthetic oligonucleotide
cggcuggaggugugagga

SEQ ID NO: 2660 - RNA, 14 nt, Artificial Sequence
  synthetic oligonucleotide
cacaccuccagccg

SEQ ID NO: 2661 - RNA, 18 nt, Artificial Sequence
  synthetic oligonucleotide
cuaagaaguugacugaag

SEQ ID NO: 2662 - RNA, 18 nt, Artificial Sequence
  synthetic oligonucleotide
cuaagaaguugacugaag

SEQ ID NO: 2663 - RNA, 14 nt, Artificial Sequence
  synthetic oligonucleotide
agucaacuucuuag

SEQ ID NO: 2664 - RNA, 19 nt, Artificial Sequence
  synthetic oligonucleotide
gacuggacaagcugaggaa

SEQ ID NO: 2665 - RNA, 19 nt, Artificial Sequence
  synthetic oligonucleotide
gacuggacaagcugaggaa

SEQ ID NO: 2666 - RNA, 14 nt, Artificial Sequence
  synthetic oligonucleotide
cagcuuguccaguc

SEQ ID NO: 2667 - RNA, 21 nt, Artificial Sequence
  synthetic oligonucleotide
gcuugucgcugcgguguugcu

SEQ ID NO: 2668 - RNA, 20 nt, Artificial Sequence
  synthetic oligonucleotide
gcuugucgcugcgguguugc

SEQ ID NO: 2669 - RNA, 14 nt, Artificial Sequence
  synthetic oligonucleotide
ccgcagcgacaagc

SEQ ID NO: 2670 - RNA, 17 nt, Artificial Sequence
  synthetic oligonucleotide
ggcgggugcgggggugg

SEQ ID NO: 2671 - RNA, 17 nt, Artificial Sequence
  synthetic oligonucleotide
ggcgggugcgggggugg

SEQ ID NO: 2672 - RNA, 14 nt, Artificial Sequence
  synthetic oligonucleotide
cccccgcacccgcc

SEQ ID NO: 2673 - RNA, 21 nt, Artificial Sequence
  synthetic oligonucleotide
ugugucccauuauuggugauu

SEQ ID NO: 2674 - RNA, 20 nt, Artificial Sequence
  synthetic oligonucleotide
ugugucccauuauuggugau

SEQ ID NO: 2675 - RNA, 14 nt, Artificial Sequence
  synthetic oligonucleotide
aauaaugggacaca

SEQ ID NO: 2676 - RNA, 22 nt, Artificial Sequence
  synthetic oligonucleotide
uuuaagaaaacaccauggagau

SEQ ID NO: 2677 - RNA, 20 nt, Artificial Sequence
  synthetic oligonucleotide
uuuaagaaaacaccauggag

SEQ ID NO: 2678 - RNA, 14 nt, Artificial Sequence
  synthetic oligonucleotide
gguguuuucuuaaa

SEQ ID NO: 2679 - RNA, 21 nt, Artificial Sequence
  synthetic oligonucleotide
ugaguguugucuacgagggca

SEQ ID NO: 2680 - RNA, 20 nt, Artificial Sequence
  synthetic oligonucleotide
ugaguguugucuacgagggc

SEQ ID NO: 2681 - RNA, 14 nt, Artificial Sequence
  synthetic oligonucleotide
guagacaacacuca

SEQ ID NO: 2682 - RNA, 21 nt, Artificial Sequence
  synthetic oligonucleotide
acugacaggagagcauuuuga

SEQ ID NO: 2683 - RNA, 20 nt, Artificial Sequence
  synthetic oligonucleotide
acugacaggagagcauuuug

SEQ ID NO: 2684 - RNA, 14 nt, Artificial Sequence
  synthetic oligonucleotide
gcucuccugucagu

SEQ ID NO: 2685 - RNA, 22 nt, Artificial Sequence
  synthetic oligonucleotide
ugaccugggacucggacagcug

SEQ ID NO: 2686 - RNA, 20 nt, Artificial Sequence
  synthetic oligonucleotide
ugaccugggacucggacagc

SEQ ID NO: 2687 - RNA, 14 nt, Artificial Sequence
  synthetic oligonucleotide
cgagucccagguca

SEQ ID NO: 2688 - RNA, 24 nt, Artificial Sequence
  synthetic oligonucleotide
gaaaaugaugaguagugacugaug

SEQ ID NO: 2689 - RNA, 20 nt, Artificial Sequence
  synthetic oligonucleotide
gaaaaugaugaguagugacu

SEQ ID NO: 2690 - RNA, 14 nt, Artificial Sequence
  synthetic oligonucleotide
uacucaucauuuuc

SEQ ID NO: 2691 - RNA, 23 nt, Artificial Sequence
  synthetic oligonucleotide
ugagcaccacacaggccgggcgc

SEQ ID NO: 2692 - RNA, 20 nt, Artificial Sequence
  synthetic oligonucleotide
ugagcaccacacaggccggg

SEQ ID NO: 2693 - RNA, 14 nt, Artificial Sequence
  synthetic oligonucleotide
cuguguggugcuca

SEQ ID NO: 2694 - RNA, 21 nt, Artificial Sequence
  synthetic oligonucleotide
gcuggucugcguggugcucgg

SEQ ID NO: 2695 - RNA, 20 nt, Artificial Sequence
  synthetic oligonucleotide
gcuggucugcguggugcucg

SEQ ID NO: 2696 - RNA, 14 nt, Artificial Sequence
  synthetic oligonucleotide
ccacgcagaccagc

SEQ ID NO: 2697 - RNA, 22 nt, Artificial Sequence
  synthetic oligonucleotide
aacucugucuucacucaugagu

SEQ ID NO: 2698 - RNA, 20 nt, Artificial Sequence
  synthetic oligonucleotide
aacucugucuucacucauga

SEQ ID NO: 2699 - RNA, 14 nt, Artificial Sequence
  synthetic oligonucleotide
gugaagacagaguu

SEQ ID NO: 2700 - RNA, 18 nt, Artificial Sequence
  synthetic oligonucleotide
agcaggugcggggcggcg

SEQ ID NO: 2701 - RNA, 18 nt, Artificial Sequence
  synthetic oligonucleotide
agcaggugcggggcggcg

SEQ ID NO: 2702 - RNA, 14 nt, Artificial Sequence
  synthetic oligonucleotide
gccccgcaccugcu

SEQ ID NO: 2703 - RNA, 21 nt, Artificial Sequence
  synthetic oligonucleotide
cagugcaaguguagaugccga

SEQ ID NO: 2704 - RNA, 20 nt, Artificial Sequence
  synthetic oligonucleotide
cagugcaaguguagaugccg

SEQ ID NO: 2705 - RNA, 14 nt, Artificial Sequence
  synthetic oligonucleotide
cuacacuugcacug

SEQ ID NO: 2706 - RNA, 22 nt, Artificial Sequence
  synthetic oligonucleotide
accuuccucuccaugggucuuu

SEQ ID NO: 2707 - RNA, 20 nt, Artificial Sequence
  synthetic oligonucleotide
accuuccucuccaugggucu

SEQ ID NO: 2708 - RNA, 14 nt, Artificial Sequence
  synthetic oligonucleotide
auggagaggaaggu

SEQ ID NO: 2709 - RNA, 22 nt, Artificial Sequence
  synthetic oligonucleotide
aaagacccauugaggagaaggu

SEQ ID NO: 2710 - RNA, 20 nt, Artificial Sequence
  synthetic oligonucleotide
aaagacccauugaggagaag

SEQ ID NO: 2711 - RNA, 14 nt, Artificial Sequence
  synthetic oligonucleotide
cucaaugggucuuu

SEQ ID NO: 2712 - RNA, 21 nt, Artificial Sequence
  synthetic oligonucleotide
aauguagagauugaucaaaau

SEQ ID NO: 2713 - RNA, 20 nt, Artificial Sequence
  synthetic oligonucleotide
aauguagagauugaucaaaa

SEQ ID NO: 2714 - RNA, 14 nt, Artificial Sequence
  synthetic oligonucleotide
ucaaucucuacauu

SEQ ID NO: 2715 - RNA, 23 nt, Artificial Sequence
  synthetic oligonucleotide
acggaauauguauacggaauaua

SEQ ID NO: 2716 - RNA, 20 nt, Artificial Sequence
  synthetic oligonucleotide
acggaauauguauacggaau

SEQ ID NO: 2717 - RNA, 14 nt, Artificial Sequence
  synthetic oligonucleotide
uauacauauuccgu

SEQ ID NO: 2718 - RNA, 22 nt, Artificial Sequence
  synthetic oligonucleotide
aauugcacuuuagcaaugguga

SEQ ID NO: 2719 - RNA, 20 nt, Artificial Sequence
  synthetic oligonucleotide
aauugcacuuuagcaauggu

SEQ ID NO: 2720 - RNA, 14 nt, Artificial Sequence
  synthetic oligonucleotide
gcuaaagugcaauu

SEQ ID NO: 2721 - RNA, 22 nt, Artificial Sequence
  synthetic oligonucleotide
acuguugcuaauaugcaacucu

SEQ ID NO: 2722 - RNA, 20 nt, Artificial Sequence
  synthetic oligonucleotide
acuguugcuaauaugcaacu

SEQ ID NO: 2723 - RNA, 14 nt, Artificial Sequence
  synthetic oligonucleotide
auauuagcaacagu

SEQ ID NO: 2724 - RNA, 24 nt, Artificial Sequence
  synthetic oligonucleotide
agagcucacagcuguccuucucua

SEQ ID NO: 2725 - RNA, 20 nt, Artificial Sequence
  synthetic oligonucleotide
agagcucacagcuguccuuc

SEQ ID NO: 2726 - RNA, 14 nt, Artificial Sequence
  synthetic oligonucleotide
cagcugugagcucu

SEQ ID NO: 2727 - RNA, 22 nt, Artificial Sequence
  synthetic oligonucleotide
aucaaauaaggacuagucugca

SEQ ID NO: 2728 - RNA, 20 nt, Artificial Sequence
  synthetic oligonucleotide
aucaaauaaggacuagucug

SEQ ID NO: 2729 - RNA, 14 nt, Artificial Sequence
  synthetic oligonucleotide
aguccuuauuugau

SEQ ID NO: 2730 - RNA, 23 nt, Artificial Sequence
  synthetic oligonucleotide
augagacucauguaaaacaucuu

SEQ ID NO: 2731 - RNA, 20 nt, Artificial Sequence
  synthetic oligonucleotide
augagacucauguaaaacau

SEQ ID NO: 2732 - RNA, 14 nt, Artificial Sequence
  synthetic oligonucleotide
uacaugagucucau

SEQ ID NO: 2733 - RNA, 21 nt, Artificial Sequence
  synthetic oligonucleotide
auggaauguauauacggaaua

SEQ ID NO: 2734 - RNA, 20 nt, Artificial Sequence
  synthetic oligonucleotide
auggaauguauauacggaau

SEQ ID NO: 2735 - RNA, 14 nt, Artificial Sequence
  synthetic oligonucleotide
uauauacauuccau

SEQ ID NO: 2736 - RNA, 22 nt, Artificial Sequence
  synthetic oligonucleotide
auuguagaaccuaagauuggcc

SEQ ID NO: 2737 - RNA, 20 nt, Artificial Sequence
  synthetic oligonucleotide
auuguagaaccuaagauugg

SEQ ID NO: 2738 - RNA, 14 nt, Artificial Sequence
  synthetic oligonucleotide
uuagguucuacaau

SEQ ID NO: 2739 - RNA, 22 nt, Artificial Sequence
  synthetic oligonucleotide
caucucuaaggaacucccccaa

SEQ ID NO: 2740 - RNA, 20 nt, Artificial Sequence
  synthetic oligonucleotide
caucucuaaggaacuccccc

SEQ ID NO: 2741 - RNA, 14 nt, Artificial Sequence
  synthetic oligonucleotide
guuccuuagagaug

SEQ ID NO: 2742 - RNA, 23 nt, Artificial Sequence
  synthetic oligonucleotide
uauggggcuucuguagagauuuc

SEQ ID NO: 2743 - RNA, 20 nt, Artificial Sequence
  synthetic oligonucleotide
uauggggcuucuguagagau

SEQ ID NO: 2744 - RNA, 14 nt, Artificial Sequence
  synthetic oligonucleotide
acagaagccccaua

SEQ ID NO: 2745 - RNA, 20 nt, Artificial Sequence
  synthetic oligonucleotide
ccguguuucccccacgcuuu

SEQ ID NO: 2746 - RNA, 20 nt, Artificial Sequence
  synthetic oligonucleotide
ccguguuucccccacgcuuu

SEQ ID NO: 2747 - RNA, 14 nt, Artificial Sequence
  synthetic oligonucleotide
ugggggaaacacgg

SEQ ID NO: 2748 - RNA, 22 nt, Artificial Sequence
  synthetic oligonucleotide
cucgugggcucuggccacggcc

SEQ ID NO: 2749 - RNA, 20 nt, Artificial Sequence
  synthetic oligonucleotide
cucgugggcucuggccacgg

SEQ ID NO: 2750 - RNA, 14 nt, Artificial Sequence
  synthetic oligonucleotide
ccagagcccacgag

SEQ ID NO: 2751 - RNA, 22 nt, Artificial Sequence
  synthetic oligonucleotide
cugcagaguuuguacggaccgg

SEQ ID NO: 2752 - RNA, 20 nt, Artificial Sequence
  synthetic oligonucleotide
cugcagaguuuguacggacc

SEQ ID NO: 2753 - RNA, 14 nt, Artificial Sequence
  synthetic oligonucleotide
uacaaacucugcag

SEQ ID NO: 2754 - RNA, 20 nt, Artificial Sequence
  synthetic oligonucleotide
uccguacaaacucugcugug

SEQ ID NO: 2755 - RNA, 20 nt, Artificial Sequence
  synthetic oligonucleotide
uccguacaaacucugcugug

SEQ ID NO: 2756 - RNA, 14 nt, Artificial Sequence
  synthetic oligonucleotide
agaguuuguacgga

SEQ ID NO: 2757 - RNA, 22 nt, Artificial Sequence
  synthetic oligonucleotide
cuuccccccaguaaucuucauc

SEQ ID NO: 2758 - RNA, 20 nt, Artificial Sequence
  synthetic oligonucleotide
cuuccccccaguaaucuuca

SEQ ID NO: 2759 - RNA, 14 nt, Artificial Sequence
  synthetic oligonucleotide
uuacuggggggaag

SEQ ID NO: 2760 - RNA, 23 nt, Artificial Sequence
  synthetic oligonucleotide
ugaggauauggcagggaagggga

SEQ ID NO: 2761 - RNA, 20 nt, Artificial Sequence
  synthetic oligonucleotide
ugaggauauggcagggaagg

SEQ ID NO: 2762 - RNA, 14 nt, Artificial Sequence
  synthetic oligonucleotide
cugccauauccuca

SEQ ID NO: 2763 - RNA, 22 nt, Artificial Sequence
  synthetic oligonucleotide
gacucacucacaggauugugca

SEQ ID NO: 2764 - RNA, 20 nt, Artificial Sequence
  synthetic oligonucleotide
gacucacucacaggauugug

SEQ ID NO: 2765 - RNA, 14 nt, Artificial Sequence
  synthetic oligonucleotide
ccugugagugaguc

SEQ ID NO: 2766 - RNA, 23 nt, Artificial Sequence
  synthetic oligonucleotide
uuuugcaugacccugggaguagg

SEQ ID NO: 2767 - RNA, 20 nt, Artificial Sequence
  synthetic oligonucleotide
uuuugcaugacccugggagu

SEQ ID NO: 2768 - RNA, 14 nt, Artificial Sequence
  synthetic oligonucleotide
agggucaugcaaaa

SEQ ID NO: 2769 - RNA, 22 nt, Artificial Sequence
  synthetic oligonucleotide
uaguggaugaugcacucugugc

SEQ ID NO: 2770 - RNA, 20 nt, Artificial Sequence
  synthetic oligonucleotide
uaguggaugaugcacucugu

SEQ ID NO: 2771 - RNA, 14 nt, Artificial Sequence
  synthetic oligonucleotide
ugcaucauccacua

SEQ ID NO: 2772 - RNA, 22 nt, Artificial Sequence
  synthetic oligonucleotide
acacagugcuucauccacuacu

SEQ ID NO: 2773 - RNA, 20 nt, Artificial Sequence
  synthetic oligonucleotide
acacagugcuucauccacua

SEQ ID NO: 2774 - RNA, 14 nt, Artificial Sequence
  synthetic oligonucleotide
augaagcacugugu

SEQ ID NO: 2775 - RNA, 21 nt, Artificial Sequence
  synthetic oligonucleotide
ugaugauacagguggagguag

SEQ ID NO: 2776 - RNA, 20 nt, Artificial Sequence
  synthetic oligonucleotide
ugaugauacagguggaggua

SEQ ID NO: 2777 - RNA, 14 nt, Artificial Sequence
  synthetic oligonucleotide
caccuguaucauca

SEQ ID NO: 2778 - RNA, 22 nt, Artificial Sequence
  synthetic oligonucleotide
ugcgacauuggaaguaguauca

SEQ ID NO: 2779 - RNA, 20 nt, Artificial Sequence
  synthetic oligonucleotide
ugcgacauuggaaguaguau

SEQ ID NO: 2780 - RNA, 14 nt, Artificial Sequence
  synthetic oligonucleotide
cuuccaaugucgca

SEQ ID NO: 2781 - RNA, 21 nt, Artificial Sequence
  synthetic oligonucleotide
uuagaccuaguacacguccuu

SEQ ID NO: 2782 - RNA, 20 nt, Artificial Sequence
  synthetic oligonucleotide
uuagaccuaguacacguccu

SEQ ID NO: 2783 - RNA, 14 nt, Artificial Sequence
  synthetic oligonucleotide
uguacuaggucuaa

SEQ ID NO: 2784 - RNA, 22 nt, Artificial Sequence
  synthetic oligonucleotide
uuuccuacccuaccugaagacu

SEQ ID NO: 2785 - RNA, 20 nt, Artificial Sequence
  synthetic oligonucleotide
uuuccuacccuaccugaaga

SEQ ID NO: 2786 - RNA, 14 nt, Artificial Sequence
  synthetic oligonucleotide
gguaggguaggaaa

SEQ ID NO: 2787 - RNA, 22 nt, Artificial Sequence
  synthetic oligonucleotide
aucuguaagagaaaguaaauga

SEQ ID NO: 2788 - RNA, 20 nt, Artificial Sequence
  synthetic oligonucleotide
aucuguaagagaaaguaaau

SEQ ID NO: 2789 - RNA, 14 nt, Artificial Sequence
  synthetic oligonucleotide
uuucucuuacagau

SEQ ID NO: 2790 - RNA, 24 nt, Artificial Sequence
  synthetic oligonucleotide
cccggacaggcguucgugcgacgu

SEQ ID NO: 2791 - RNA, 20 nt, Artificial Sequence
  synthetic oligonucleotide
cccggacaggcguucgugcg

SEQ ID NO: 2792 - RNA, 14 nt, Artificial Sequence
  synthetic oligonucleotide
aacgccuguccggg

SEQ ID NO: 2793 - RNA, 22 nt, Artificial Sequence
  synthetic oligonucleotide
uauggaaagacuuugccacucu

SEQ ID NO: 2794 - RNA, 20 nt, Artificial Sequence
  synthetic oligonucleotide
uauggaaagacuuugccacu

SEQ ID NO: 2795 - RNA, 14 nt, Artificial Sequence
  synthetic oligonucleotide
aaagucuuuccaua

SEQ ID NO: 2796 - RNA, 22 nt, Artificial Sequence
  synthetic oligonucleotide
cugggaggugugauaucguggu

SEQ ID NO: 2797 - RNA, 20 nt, Artificial Sequence
  synthetic oligonucleotide
cugggaggugugauaucgug

SEQ ID NO: 2798 - RNA, 14 nt, Artificial Sequence
  synthetic oligonucleotide
aucacaccucccag

SEQ ID NO: 2799 - RNA, 22 nt, Artificial Sequence
  synthetic oligonucleotide
ugugauaucaugguuccuggga

SEQ ID NO: 2800 - RNA, 20 nt, Artificial Sequence
  synthetic oligonucleotide
ugugauaucaugguuccugg

SEQ ID NO: 2801 - RNA, 14 nt, Artificial Sequence
  synthetic oligonucleotide
accaugauaucaca

SEQ ID NO: 2802 - RNA, 22 nt, Artificial Sequence
  synthetic oligonucleotide
ugugauaucaugguuccuggga

SEQ ID NO: 2803 - RNA, 20 nt, Artificial Sequence
  synthetic oligonucleotide
ugugauaucaugguuccugg

SEQ ID NO: 2804 - RNA, 14 nt, Artificial Sequence
  synthetic oligonucleotide
accaugauaucaca

SEQ ID NO: 2805 - RNA, 22 nt, Artificial Sequence
  synthetic oligonucleotide
cugggaggugugauauuguggu

SEQ ID NO: 2806 - RNA, 20 nt, Artificial Sequence
  synthetic oligonucleotide
cugggaggugugauauugug

SEQ ID NO: 2807 - RNA, 14 nt, Artificial Sequence
  synthetic oligonucleotide
aucacaccucccag

SEQ ID NO: 2808 - RNA, 23 nt, Artificial Sequence
  synthetic oligonucleotide
accuggacccagcguagacaaag

SEQ ID NO: 2809 - RNA, 20 nt, Artificial Sequence
  synthetic oligonucleotide
accuggacccagcguagaca

SEQ ID NO: 2810 - RNA, 14 nt, Artificial Sequence
  synthetic oligonucleotide
cgcuggguccaggu

SEQ ID NO: 2811 - RNA, 23 nt, Artificial Sequence
  synthetic oligonucleotide
aguggaugauggagacucgguac

SEQ ID NO: 2812 - RNA, 20 nt, Artificial Sequence
  synthetic oligonucleotide
aguggaugauggagacucgg

SEQ ID NO: 2813 - RNA, 14 nt, Artificial Sequence
  synthetic oligonucleotide
cuccaucauccacu

SEQ ID NO: 2814 - RNA, 24 nt, Artificial Sequence
  synthetic oligonucleotide
guuccacacugacacugcagaagu

SEQ ID NO: 2815 - RNA, 20 nt, Artificial Sequence
  synthetic oligonucleotide
guuccacacugacacugcag

SEQ ID NO: 2816 - RNA, 14 nt, Artificial Sequence
  synthetic oligonucleotide
ugucaguguggaac

SEQ ID NO: 2817 - RNA, 24 nt, Artificial Sequence
  synthetic oligonucleotide
ccugcuggucaggaguggauacug

SEQ ID NO: 2818 - RNA, 20 nt, Artificial Sequence
  synthetic oligonucleotide
ccugcuggucaggaguggau

SEQ ID NO: 2819 - RNA, 14 nt, Artificial Sequence
  synthetic oligonucleotide
uccugaccagcagg

SEQ ID NO: 2820 - RNA, 21 nt, Artificial Sequence
  synthetic oligonucleotide
aauaauacaugguugaucuuu

SEQ ID NO: 2821 - RNA, 20 nt, Artificial Sequence
  synthetic oligonucleotide
aauaauacaugguugaucuu

SEQ ID NO: 2822 - RNA, 14 nt, Artificial Sequence
  synthetic oligonucleotide
aaccauguauuauu

SEQ ID NO: 2823 - RNA, 22 nt, Artificial Sequence
  synthetic oligonucleotide
agaucgaccguguuauauucgc

SEQ ID NO: 2824 - RNA, 20 nt, Artificial Sequence
  synthetic oligonucleotide
agaucgaccguguuauauuc

SEQ ID NO: 2825 - RNA, 14 nt, Artificial Sequence
  synthetic oligonucleotide
aacacggucgaucu

SEQ ID NO: 2826 - RNA, 22 nt, Artificial Sequence
  synthetic oligonucleotide
gccugcugggguggaaccuggu

SEQ ID NO: 2827 - RNA, 20 nt, Artificial Sequence
  synthetic oligonucleotide
gccugcugggguggaaccug

SEQ ID NO: 2828 - RNA, 14 nt, Artificial Sequence
  synthetic oligonucleotide
ccaccccagcaggc

SEQ ID NO: 2829 - RNA, 20 nt, Artificial Sequence
  synthetic oligonucleotide
gguauccguuuggggauggu

SEQ ID NO: 2830 - RNA, 20 nt, Artificial Sequence
  synthetic oligonucleotide
gguauccguuuggggauggu

SEQ ID NO: 2831 - RNA, 14 nt, Artificial Sequence
  synthetic oligonucleotide
cccaaacggauacc

SEQ ID NO: 2832 - RNA, 23 nt, Artificial Sequence
  synthetic oligonucleotide
aagugccgccaucuuuugagugu

SEQ ID NO: 2833 - RNA, 20 nt, Artificial Sequence
  synthetic oligonucleotide
aagugccgccaucuuuugag

SEQ ID NO: 2834 - RNA, 14 nt, Artificial Sequence
  synthetic oligonucleotide
agauggcggcacuu

SEQ ID NO: 2835 - RNA, 22 nt, Artificial Sequence
  synthetic oligonucleotide
gaaggcagcagugcuccccugu

SEQ ID NO: 2836 - RNA, 20 nt, Artificial Sequence
  synthetic oligonucleotide
gaaggcagcagugcuccccu

SEQ ID NO: 2837 - RNA, 14 nt, Artificial Sequence
  synthetic oligonucleotide
gcacugcugccuuc

SEQ ID NO: 2838 - RNA, 20 nt, Artificial Sequence
  synthetic oligonucleotide
acucaaacugugggggcacu

SEQ ID NO: 2839 - RNA, 20 nt, Artificial Sequence
  synthetic oligonucleotide
acucaaacugugggggcacu

SEQ ID NO: 2840 - RNA, 14 nt, Artificial Sequence
  synthetic oligonucleotide
cccacaguuugagu

SEQ ID NO: 2841 - RNA, 23 nt, Artificial Sequence
  synthetic oligonucleotide
aaagugcugcgacauuugagcgu

SEQ ID NO: 2842 - RNA, 20 nt, Artificial Sequence
  synthetic oligonucleotide
aaagugcugcgacauuugag

SEQ ID NO: 2843 - RNA, 14 nt, Artificial Sequence
  synthetic oligonucleotide
ugucgcagcacuuu

SEQ ID NO: 2844 - RNA, 23 nt, Artificial Sequence
  synthetic oligonucleotide
gaagugcuucgauuuuggggugu

SEQ ID NO: 2845 - RNA, 20 nt, Artificial Sequence
  synthetic oligonucleotide
gaagugcuucgauuuugggg

SEQ ID NO: 2846 - RNA, 14 nt, Artificial Sequence
  synthetic oligonucleotide
aaucgaagcacuuc

SEQ ID NO: 2847 - RNA, 22 nt, Artificial Sequence
  synthetic oligonucleotide
acucaaaaugggggcgcuuucc

SEQ ID NO: 2848 - RNA, 20 nt, Artificial Sequence
  synthetic oligonucleotide
acucaaaaugggggcgcuuu

SEQ ID NO: 2849 - RNA, 14 nt, Artificial Sequence
  synthetic oligonucleotide
cccccauuuugagu

SEQ ID NO: 2850 - RNA, 22 nt, Artificial Sequence
  synthetic oligonucleotide
uuauaauacaaccugauaagug

SEQ ID NO: 2851 - RNA, 20 nt, Artificial Sequence
  synthetic oligonucleotide
uuauaauacaaccugauaag

SEQ ID NO: 2852 - RNA, 14 nt, Artificial Sequence
  synthetic oligonucleotide
agguuguauuauaa

SEQ ID NO: 2853 - RNA, 22 nt, Artificial Sequence
  synthetic oligonucleotide
cuuaucagauuguauuguaauu

SEQ ID NO: 2854 - RNA, 20 nt, Artificial Sequence
  synthetic oligonucleotide
cuuaucagauuguauuguaa

SEQ ID NO: 2855 - RNA, 14 nt, Artificial Sequence
  synthetic oligonucleotide
uacaaucugauaag

SEQ ID NO: 2856 - RNA, 22 nt, Artificial Sequence
  synthetic oligonucleotide
auauaauacaaccugcuaagug

SEQ ID NO: 2857 - RNA, 20 nt, Artificial Sequence
  synthetic oligonucleotide
auauaauacaaccugcuaag

SEQ ID NO: 2858 - RNA, 14 nt, Artificial Sequence
  synthetic oligonucleotide
agguuguauuauau

SEQ ID NO: 2859 - RNA, 22 nt, Artificial Sequence
  synthetic oligonucleotide
cuuagcagguuguauuaucauu

SEQ ID NO: 2860 - RNA, 20 nt, Artificial Sequence
  synthetic oligonucleotide
cuuagcagguuguauuauca

SEQ ID NO: 2861 - RNA, 14 nt, Artificial Sequence
  synthetic oligonucleotide
uacaaccugcuaag

SEQ ID NO: 2862 - RNA, 22 nt, Artificial Sequence
  synthetic oligonucleotide
auaauacaaccugcuaagugcu

SEQ ID NO: 2863 - RNA, 20 nt, Artificial Sequence
  synthetic oligonucleotide
auaauacaaccugcuaagug

SEQ ID NO: 2864 - RNA, 14 nt, Artificial Sequence
  synthetic oligonucleotide
gcagguuguauuau

SEQ ID NO: 2865 - RNA, 22 nt, Artificial Sequence
  synthetic oligonucleotide
uuuguucguucggcucgcguga

SEQ ID NO: 2866 - RNA, 20 nt, Artificial Sequence
  synthetic oligonucleotide
uuuguucguucggcucgcgu

SEQ ID NO: 2867 - RNA, 14 nt, Artificial Sequence
  synthetic oligonucleotide
gccgaacgaacaaa

SEQ ID NO: 2868 - RNA, 21 nt, Artificial Sequence
  synthetic oligonucleotide
aucauagaggaaaauccacgu

SEQ ID NO: 2869 - RNA, 20 nt, Artificial Sequence
  synthetic oligonucleotide
aucauagaggaaaauccacg

SEQ ID NO: 2870 - RNA, 14 nt, Artificial Sequence
  synthetic oligonucleotide
uuuuccucuaugau

SEQ ID NO: 2871 - RNA, 22 nt, Artificial Sequence
  synthetic oligonucleotide
guagauucuccuucuaugagua

SEQ ID NO: 2872 - RNA, 20 nt, Artificial Sequence
  synthetic oligonucleotide
guagauucuccuucuaugag

SEQ ID NO: 2873 - RNA, 14 nt, Artificial Sequence
  synthetic oligonucleotide
gaaggagaaucuac

SEQ ID NO: 2874 - RNA, 22 nt, Artificial Sequence
  synthetic oligonucleotide
aucauagaggaaaauccauguu

SEQ ID NO: 2875 - RNA, 20 nt, Artificial Sequence
  synthetic oligonucleotide
aucauagaggaaaauccaug

SEQ ID NO: 2876 - RNA, 14 nt, Artificial Sequence
  synthetic oligonucleotide
uuuuccucuaugau

SEQ ID NO: 2877 - RNA, 21 nt, Artificial Sequence
  synthetic oligonucleotide
aacauagaggaaauuccacgu

SEQ ID NO: 2878 - RNA, 20 nt, Artificial Sequence
  synthetic oligonucleotide
aacauagaggaaauuccacg

SEQ ID NO: 2879 - RNA, 14 nt, Artificial Sequence
  synthetic oligonucleotide
auuuccucuauguu

SEQ ID NO: 2880 - RNA, 22 nt, Artificial Sequence
  synthetic oligonucleotide
aucacacaaaggcaacuuuugu

SEQ ID NO: 2881 - RNA, 20 nt, Artificial Sequence
  synthetic oligonucleotide
aucacacaaaggcaacuuuu

SEQ ID NO: 2882 - RNA, 14 nt, Artificial Sequence
  synthetic oligonucleotide
ugccuuugugugau

SEQ ID NO: 2883 - RNA, 22 nt, Artificial Sequence
  synthetic oligonucleotide
agagguugcccuuggugaauuc

SEQ ID NO: 2884 - RNA, 20 nt, Artificial Sequence
  synthetic oligonucleotide
agagguugcccuuggugaau

SEQ ID NO: 2885 - RNA, 14 nt, Artificial Sequence
  synthetic oligonucleotide
caagggcaaccucu

SEQ ID NO: 2886 - RNA, 21 nt, Artificial Sequence
  synthetic oligonucleotide
acuggacuuggagucagaagg

SEQ ID NO: 2887 - RNA, 20 nt, Artificial Sequence
  synthetic oligonucleotide
acuggacuuggagucagaag

SEQ ID NO: 2888 - RNA, 14 nt, Artificial Sequence
  synthetic oligonucleotide
acuccaaguccagu

SEQ ID NO: 2889 - RNA, 22 nt, Artificial Sequence
  synthetic oligonucleotide
cuccugacuccagguccugugu

SEQ ID NO: 2890 - RNA, 20 nt, Artificial Sequence
  synthetic oligonucleotide
cuccugacuccagguccugu

SEQ ID NO: 2891 - RNA, 14 nt, Artificial Sequence
  synthetic oligonucleotide
ccuggagucaggag

SEQ ID NO: 2892 - RNA, 19 nt, Artificial Sequence
  synthetic oligonucleotide
acuggacuuggaggcagaa

SEQ ID NO: 2893 - RNA, 19 nt, Artificial Sequence
  synthetic oligonucleotide
acuggacuuggaggcagaa

SEQ ID NO: 2894 - RNA, 14 nt, Artificial Sequence
  synthetic oligonucleotide
ccuccaaguccagu

SEQ ID NO: 2895 - RNA, 25 nt, Artificial Sequence
  synthetic oligonucleotide
acuggacuuggagucagaagagugg

SEQ ID NO: 2896 - RNA, 20 nt, Artificial Sequence
  synthetic oligonucleotide
acuggacuuggagucagaag

SEQ ID NO: 2897 - RNA, 14 nt, Artificial Sequence
  synthetic oligonucleotide
acuccaaguccagu

SEQ ID NO: 2898 - RNA, 21 nt, Artificial Sequence
  synthetic oligonucleotide
ugguagacuauggaacguagg

SEQ ID NO: 2899 - RNA, 20 nt, Artificial Sequence
  synthetic oligonucleotide
ugguagacuauggaacguag

SEQ ID NO: 2900 - RNA, 14 nt, Artificial Sequence
  synthetic oligonucleotide
uccauagucuacca

SEQ ID NO: 2901 - RNA, 22 nt, Artificial Sequence
  synthetic oligonucleotide
uauguaacaugguccacuaacu

SEQ ID NO: 2902 - RNA, 20 nt, Artificial Sequence
  synthetic oligonucleotide
uauguaacaugguccacuaa

SEQ ID NO: 2903 - RNA, 14 nt, Artificial Sequence
  synthetic oligonucleotide
gaccauguuacaua

SEQ ID NO: 2904 - RNA, 22 nt, Artificial Sequence
  synthetic oligonucleotide
uauguaauaugguccacaucuu

SEQ ID NO: 2905 - RNA, 20 nt, Artificial Sequence
  synthetic oligonucleotide
uauguaauaugguccacauc

SEQ ID NO: 2906 - RNA, 14 nt, Artificial Sequence
  synthetic oligonucleotide
gaccauauuacaua

SEQ ID NO: 2907 - RNA, 22 nt, Artificial Sequence
  synthetic oligonucleotide
ugguugaccauagaacaugcgc

SEQ ID NO: 2908 - RNA, 20 nt, Artificial Sequence
  synthetic oligonucleotide
ugguugaccauagaacaugc

SEQ ID NO: 2909 - RNA, 14 nt, Artificial Sequence
  synthetic oligonucleotide
ucuauggucaacca

SEQ ID NO: 2910 - RNA, 22 nt, Artificial Sequence
  synthetic oligonucleotide
uauacaagggcaagcucucugu

SEQ ID NO: 2911 - RNA, 20 nt, Artificial Sequence
  synthetic oligonucleotide
uauacaagggcaagcucucu

SEQ ID NO: 2912 - RNA, 14 nt, Artificial Sequence
  synthetic oligonucleotide
cuugcccuuguaua

SEQ ID NO: 2913 - RNA, 22 nt, Artificial Sequence
  synthetic oligonucleotide
gaaguuguucgugguggauucg

SEQ ID NO: 2914 - RNA, 20 nt, Artificial Sequence
  synthetic oligonucleotide
gaaguuguucgugguggauu

SEQ ID NO: 2915 - RNA, 14 nt, Artificial Sequence
  synthetic oligonucleotide
ccacgaacaacuuc

SEQ ID NO: 2916 - RNA, 22 nt, Artificial Sequence
  synthetic oligonucleotide
agaucagaaggugauuguggcu

SEQ ID NO: 2917 - RNA, 20 nt, Artificial Sequence
  synthetic oligonucleotide
agaucagaaggugauugugg

SEQ ID NO: 2918 - RNA, 14 nt, Artificial Sequence
  synthetic oligonucleotide
ucaccuucugaucu

SEQ ID NO: 2919 - RNA, 20 nt, Artificial Sequence
  synthetic oligonucleotide
auuccuagaaauuguucaua

SEQ ID NO: 2920 - RNA, 20 nt, Artificial Sequence
  synthetic oligonucleotide
auuccuagaaauuguucaua

SEQ ID NO: 2921 - RNA, 14 nt, Artificial Sequence
  synthetic oligonucleotide
caauuucuaggaau

SEQ ID NO: 2922 - RNA, 22 nt, Artificial Sequence
  synthetic oligonucleotide
aggugcuccaggcuggcucaca

SEQ ID NO: 2923 - RNA, 20 nt, Artificial Sequence
  synthetic oligonucleotide
aggugcuccaggcuggcuca

SEQ ID NO: 2924 - RNA, 14 nt, Artificial Sequence
  synthetic oligonucleotide
agccuggagcaccu

SEQ ID NO: 2925 - RNA, 22 nt, Artificial Sequence
  synthetic oligonucleotide
gagcaauguagguagacuguuu

SEQ ID NO: 2926 - RNA, 20 nt, Artificial Sequence
  synthetic oligonucleotide
gagcaauguagguagacugu

SEQ ID NO: 2927 - RNA, 14 nt, Artificial Sequence
  synthetic oligonucleotide
uaccuacauugcuc

SEQ ID NO: 2928 - RNA, 22 nt, Artificial Sequence
  synthetic oligonucleotide
uguccucuagggccugcagucu

SEQ ID NO: 2929 - RNA, 20 nt, Artificial Sequence
  synthetic oligonucleotide
uguccucuagggccugcagu

SEQ ID NO: 2930 - RNA, 14 nt, Artificial Sequence
  synthetic oligonucleotide
ggcccuagaggaca

SEQ ID NO: 2931 - RNA, 20 nt, Artificial Sequence
  synthetic oligonucleotide
aaaggcauaaaaccaagaca

SEQ ID NO: 2932 - RNA, 20 nt, Artificial Sequence
  synthetic oligonucleotide
aaaggcauaaaaccaagaca

SEQ ID NO: 2933 - RNA, 14 nt, Artificial Sequence
  synthetic oligonucleotide
gguuuuaugccuuu

SEQ ID NO: 2934 - RNA, 22 nt, Artificial Sequence
  synthetic oligonucleotide
uguguggauccuggaggaggca

SEQ ID NO: 2935 - RNA, 20 nt, Artificial Sequence
  synthetic oligonucleotide
uguguggauccuggaggagg

SEQ ID NO: 2936 - RNA, 14 nt, Artificial Sequence
  synthetic oligonucleotide
ccaggauccacaca

SEQ ID NO: 2937 - RNA, 21 nt, Artificial Sequence
  synthetic oligonucleotide
uaacgcauaauauggacaugu

SEQ ID NO: 2938 - RNA, 20 nt, Artificial Sequence
  synthetic oligonucleotide
uaacgcauaauauggacaug

SEQ ID NO: 2939 - RNA, 14 nt, Artificial Sequence
  synthetic oligonucleotide
cauauuaugcguua

SEQ ID NO: 2940 - RNA, 22 nt, Artificial Sequence
  synthetic oligonucleotide
uuugggacugaucuugaugucu

SEQ ID NO: 2941 - RNA, 20 nt, Artificial Sequence
  synthetic oligonucleotide
uuugggacugaucuugaugu

SEQ ID NO: 2942 - RNA, 14 nt, Artificial Sequence
  synthetic oligonucleotide
agaucagucccaaa

SEQ ID NO: 2943 - RNA, 22 nt, Artificial Sequence
  synthetic oligonucleotide
aaggaaccagaaaaugagaagu

SEQ ID NO: 2944 - RNA, 20 nt, Artificial Sequence
  synthetic oligonucleotide
aaggaaccagaaaaugagaa

SEQ ID NO: 2945 - RNA, 14 nt, Artificial Sequence
  synthetic oligonucleotide
uuuucugguuccuu

SEQ ID NO: 2946 - RNA, 22 nt, Artificial Sequence
  synthetic oligonucleotide
uugaggaaaagauggucuuauu

SEQ ID NO: 2947 - RNA, 20 nt, Artificial Sequence
  synthetic oligonucleotide
uugaggaaaagauggucuua

SEQ ID NO: 2948 - RNA, 14 nt, Artificial Sequence
  synthetic oligonucleotide
caucuuuuccucaa

SEQ ID NO: 2949 - RNA, 26 nt, Artificial Sequence
  synthetic oligonucleotide
aagaggaagaaauggcugguucucag

SEQ ID NO: 2950 - RNA, 20 nt, Artificial Sequence
  synthetic oligonucleotide
aagaggaagaaauggcuggu

SEQ ID NO: 2951 - RNA, 14 nt, Artificial Sequence
  synthetic oligonucleotide
cauuucuuccucuu

SEQ ID NO: 2952 - RNA, 20 nt, Artificial Sequence
  synthetic oligonucleotide
gcucggacugagcagguggg

SEQ ID NO: 2953 - RNA, 20 nt, Artificial Sequence
  synthetic oligonucleotide
gcucggacugagcagguggg

SEQ ID NO: 2954 - RNA, 14 nt, Artificial Sequence
  synthetic oligonucleotide
ugcucaguccgagc

SEQ ID NO: 2955 - RNA, 21 nt, Artificial Sequence
  synthetic oligonucleotide
acagggccgcagauggagacu

SEQ ID NO: 2956 - RNA, 20 nt, Artificial Sequence
  synthetic oligonucleotide
acagggccgcagauggagac

SEQ ID NO: 2957 - RNA, 14 nt, Artificial Sequence
  synthetic oligonucleotide
aucugcggcccugu

SEQ ID NO: 2958 - RNA, 21 nt, Artificial Sequence
  synthetic oligonucleotide
gcagagaacaaaggacucagu

SEQ ID NO: 2959 - RNA, 20 nt, Artificial Sequence
  synthetic oligonucleotide
gcagagaacaaaggacucag

SEQ ID NO: 2960 - RNA, 14 nt, Artificial Sequence
  synthetic oligonucleotide
ccuuuguucucugc

SEQ ID NO: 2961 - RNA, 22 nt, Artificial Sequence
  synthetic oligonucleotide
acugauuaucuuaacucucuga

SEQ ID NO: 2962 - RNA, 20 nt, Artificial Sequence
  synthetic oligonucleotide
acugauuaucuuaacucucu

SEQ ID NO: 2963 - RNA, 14 nt, Artificial Sequence
  synthetic oligonucleotide
uuaagauaaucagu

SEQ ID NO: 2964 - RNA, 23 nt, Artificial Sequence
  synthetic oligonucleotide
ucucugaguaccauaugccuugu

SEQ ID NO: 2965 - RNA, 20 nt, Artificial Sequence
  synthetic oligonucleotide
ucucugaguaccauaugccu

SEQ ID NO: 2966 - RNA, 14 nt, Artificial Sequence
  synthetic oligonucleotide
augguacucagaga

SEQ ID NO: 2967 - RNA, 22 nt, Artificial Sequence
  synthetic oligonucleotide
ucuggccuugacuugacucuuu

SEQ ID NO: 2968 - RNA, 20 nt, Artificial Sequence
  synthetic oligonucleotide
ucuggccuugacuugacucu

SEQ ID NO: 2969 - RNA, 14 nt, Artificial Sequence
  synthetic oligonucleotide
aagucaaggccaga

SEQ ID NO: 2970 - RNA, 22 nt, Artificial Sequence
  synthetic oligonucleotide
aacuaguaauguuggauuaggg

SEQ ID NO: 2971 - RNA, 20 nt, Artificial Sequence
  synthetic oligonucleotide
aacuaguaauguuggauuag

SEQ ID NO: 2972 - RNA, 14 nt, Artificial Sequence
  synthetic oligonucleotide
caacauuacuaguu

SEQ ID NO: 2973 - RNA, 22 nt, Artificial Sequence
  synthetic oligonucleotide
auauguauaugugacugcuacu

SEQ ID NO: 2974 - RNA, 20 nt, Artificial Sequence
  synthetic oligonucleotide
auauguauaugugacugcua

SEQ ID NO: 2975 - RNA, 14 nt, Artificial Sequence
  synthetic oligonucleotide
ucacauauacauau

SEQ ID NO: 2976 - RNA, 22 nt, Artificial Sequence
  synthetic oligonucleotide
aagagaacugaaaguggagccu

SEQ ID NO: 2977 - RNA, 20 nt, Artificial Sequence
  synthetic oligonucleotide
aagagaacugaaaguggagc

SEQ ID NO: 2978 - RNA, 14 nt, Artificial Sequence
  synthetic oligonucleotide
cuuucaguucucuu

SEQ ID NO: 2979 - RNA, 21 nt, Artificial Sequence
  synthetic oligonucleotide
uggccaaaaagcaggcagaga

SEQ ID NO: 2980 - RNA, 20 nt, Artificial Sequence
  synthetic oligonucleotide
uggccaaaaagcaggcagag

SEQ ID NO: 2981 - RNA, 14 nt, Artificial Sequence
  synthetic oligonucleotide
cugcuuuuuggcca

SEQ ID NO: 2982 - RNA, 22 nt, Artificial Sequence
  synthetic oligonucleotide
cagguagauauuugauaggcau

SEQ ID NO: 2983 - RNA, 20 nt, Artificial Sequence
  synthetic oligonucleotide
cagguagauauuugauaggc

SEQ ID NO: 2984 - RNA, 14 nt, Artificial Sequence
  synthetic oligonucleotide
caaauaucuaccug

SEQ ID NO: 2985 - RNA, 22 nt, Artificial Sequence
  synthetic oligonucleotide
ggaggaaccuuggagcuucggc

SEQ ID NO: 2986 - RNA, 20 nt, Artificial Sequence
  synthetic oligonucleotide
ggaggaaccuuggagcuucg

SEQ ID NO: 2987 - RNA, 14 nt, Artificial Sequence
  synthetic oligonucleotide
uccaagguuccucc

SEQ ID NO: 2988 - RNA, 23 nt, Artificial Sequence
  synthetic oligonucleotide
gaggcugaugugaguagaccacu

SEQ ID NO: 2989 - RNA, 20 nt, Artificial Sequence
  synthetic oligonucleotide
gaggcugaugugaguagacc

SEQ ID NO: 2990 - RNA, 14 nt, Artificial Sequence
  synthetic oligonucleotide
cucacaucagccuc

SEQ ID NO: 2991 - RNA, 22 nt, Artificial Sequence
  synthetic oligonucleotide
ucagguguggaaacugaggcag

SEQ ID NO: 2992 - RNA, 20 nt, Artificial Sequence
  synthetic oligonucleotide
ucagguguggaaacugaggc

SEQ ID NO: 2993 - RNA, 14 nt, Artificial Sequence
  synthetic oligonucleotide
guuuccacaccuga

SEQ ID NO: 2994 - RNA, 22 nt, Artificial Sequence
  synthetic oligonucleotide
uguagauacgagcaccagccac

SEQ ID NO: 2995 - RNA, 20 nt, Artificial Sequence
  synthetic oligonucleotide
uguagauacgagcaccagcc

SEQ ID NO: 2996 - RNA, 14 nt, Artificial Sequence
  synthetic oligonucleotide
ugcucguaucuaca

SEQ ID NO: 2997 - RNA, 22 nt, Artificial Sequence
  synthetic oligonucleotide
uaagggguguauggcagaugca

SEQ ID NO: 2998 - RNA, 20 nt, Artificial Sequence
  synthetic oligonucleotide
uaagggguguauggcagaug

SEQ ID NO: 2999 - RNA, 14 nt, Artificial Sequence
  synthetic oligonucleotide
ccauacaccccuua

SEQ ID NO: 3000 - RNA, 23 nt, Artificial Sequence
  synthetic oligonucleotide
acaggcggcuguagcaauggggg

SEQ ID NO: 3001 - RNA, 20 nt, Artificial Sequence
  synthetic oligonucleotide
acaggcggcuguagcaaugg

SEQ ID NO: 3002 - RNA, 14 nt, Artificial Sequence
  synthetic oligonucleotide
cuacagccgccugu

SEQ ID NO: 3003 - RNA, 22 nt, Artificial Sequence
  synthetic oligonucleotide
aauucccuuguagauaacccgg

SEQ ID NO: 3004 - RNA, 20 nt, Artificial Sequence
  synthetic oligonucleotide
aauucccuuguagauaaccc

SEQ ID NO: 3005 - RNA, 14 nt, Artificial Sequence
  synthetic oligonucleotide
ucuacaagggaauu

SEQ ID NO: 3006 - RNA, 22 nt, Artificial Sequence
  synthetic oligonucleotide
uacgcgcagaccacaggauguc

SEQ ID NO: 3007 - RNA, 20 nt, Artificial Sequence
  synthetic oligonucleotide
uacgcgcagaccacaggaug

SEQ ID NO: 3008 - RNA, 14 nt, Artificial Sequence
  synthetic oligonucleotide
guggucugcgcgua

SEQ ID NO: 3009 - RNA, 22 nt, Artificial Sequence
  synthetic oligonucleotide
cagcccggaucccagcccacuu

SEQ ID NO: 3010 - RNA, 20 nt, Artificial Sequence
  synthetic oligonucleotide
cagcccggaucccagcccac

SEQ ID NO: 3011 - RNA, 14 nt, Artificial Sequence
  synthetic oligonucleotide
ugggauccgggcug

SEQ ID NO: 3012 - RNA, 22 nt, Artificial Sequence
  synthetic oligonucleotide
uuacacacaacugaggaucaua

SEQ ID NO: 3013 - RNA, 20 nt, Artificial Sequence
  synthetic oligonucleotide
uuacacacaacugaggauca

SEQ ID NO: 3014 - RNA, 14 nt, Artificial Sequence
  synthetic oligonucleotide
ucaguuguguguaa

SEQ ID NO: 3015 - RNA, 22 nt, Artificial Sequence
  synthetic oligonucleotide
aagcaauacuguuaccugaaau

SEQ ID NO: 3016 - RNA, 20 nt, Artificial Sequence
  synthetic oligonucleotide
aagcaauacuguuaccugaa

SEQ ID NO: 3017 - RNA, 14 nt, Artificial Sequence
  synthetic oligonucleotide
uaacaguauugcuu

SEQ ID NO: 3018 - RNA, 23 nt, Artificial Sequence
  synthetic oligonucleotide
uagcccccaggcuucacuuggcg

SEQ ID NO: 3019 - RNA, 20 nt, Artificial Sequence
  synthetic oligonucleotide
uagcccccaggcuucacuug

SEQ ID NO: 3020 - RNA, 14 nt, Artificial Sequence
  synthetic oligonucleotide
aagccugggggcua

SEQ ID NO: 3021 - RNA, 23 nt, Artificial Sequence
  synthetic oligonucleotide
uucgggcuggccugcugcuccgg

SEQ ID NO: 3022 - RNA, 20 nt, Artificial Sequence
  synthetic oligonucleotide
uucgggcuggccugcugcuc

SEQ ID NO: 3023 - RNA, 14 nt, Artificial Sequence
  synthetic oligonucleotide
caggccagcccgaa

SEQ ID NO: 3024 - RNA, 23 nt, Artificial Sequence
  synthetic oligonucleotide
agggcauaggagaggguugauau

SEQ ID NO: 3025 - RNA, 20 nt, Artificial Sequence
  synthetic oligonucleotide
agggcauaggagaggguuga

SEQ ID NO: 3026 - RNA, 14 nt, Artificial Sequence
  synthetic oligonucleotide
cucuccuaugcccu

SEQ ID NO: 3027 - RNA, 22 nt, Artificial Sequence
  synthetic oligonucleotide
gaauguugcucggugaaccccu

SEQ ID NO: 3028 - RNA, 20 nt, Artificial Sequence
  synthetic oligonucleotide
gaauguugcucggugaaccc

SEQ ID NO: 3029 - RNA, 14 nt, Artificial Sequence
  synthetic oligonucleotide
accgagcaacauuc

SEQ ID NO: 3030 - RNA, 23 nt, Artificial Sequence
  synthetic oligonucleotide
agguuacccgagcaacuuugcau

SEQ ID NO: 3031 - RNA, 20 nt, Artificial Sequence
  synthetic oligonucleotide
agguuacccgagcaacuuug

SEQ ID NO: 3032 - RNA, 14 nt, Artificial Sequence
  synthetic oligonucleotide
ugcucggguaaccu

SEQ ID NO: 3033 - RNA, 21 nt, Artificial Sequence
  synthetic oligonucleotide
aauauaacacagauggccugu

SEQ ID NO: 3034 - RNA, 20 nt, Artificial Sequence
  synthetic oligonucleotide
aauauaacacagauggccug

SEQ ID NO: 3035 - RNA, 14 nt, Artificial Sequence
  synthetic oligonucleotide
aucuguguuauauu

SEQ ID NO: 3036 - RNA, 21 nt, Artificial Sequence
  synthetic oligonucleotide
uaguagaccguauagcguacg

SEQ ID NO: 3037 - RNA, 20 nt, Artificial Sequence
  synthetic oligonucleotide
uaguagaccguauagcguac

SEQ ID NO: 3038 - RNA, 14 nt, Artificial Sequence
  synthetic oligonucleotide
uauacggucuacua

SEQ ID NO: 3039 - RNA, 22 nt, Artificial Sequence
  synthetic oligonucleotide
uauguaacacgguccacuaacc

SEQ ID NO: 3040 - RNA, 20 nt, Artificial Sequence
  synthetic oligonucleotide
uauguaacacgguccacuaa

SEQ ID NO: 3041 - RNA, 14 nt, Artificial Sequence
  synthetic oligonucleotide
gaccguguuacaua

SEQ ID NO: 3042 - RNA, 23 nt, Artificial Sequence
  synthetic oligonucleotide
acuucaccugguccacuagccgu

SEQ ID NO: 3043 - RNA, 20 nt, Artificial Sequence
  synthetic oligonucleotide
acuucaccugguccacuagc

SEQ ID NO: 3044 - RNA, 14 nt, Artificial Sequence
  synthetic oligonucleotide
ggaccaggugaagu

SEQ ID NO: 3045 - RNA, 23 nt, Artificial Sequence
  synthetic oligonucleotide
aucaacagacauuaauugggcgc

SEQ ID NO: 3046 - RNA, 20 nt, Artificial Sequence
  synthetic oligonucleotide
aucaacagacauuaauuggg

SEQ ID NO: 3047 - RNA, 14 nt, Artificial Sequence
  synthetic oligonucleotide
uaaugucuguugau

SEQ ID NO: 3048 - RNA, 22 nt, Artificial Sequence
  synthetic oligonucleotide
acuggacuuagggucagaaggc

SEQ ID NO: 3049 - RNA, 20 nt, Artificial Sequence
  synthetic oligonucleotide
acuggacuuagggucagaag

SEQ ID NO: 3050 - RNA, 14 nt, Artificial Sequence
  synthetic oligonucleotide
acccuaaguccagu

SEQ ID NO: 3051 - RNA, 23 nt, Artificial Sequence
  synthetic oligonucleotide
agcucggucugaggccccucagu

SEQ ID NO: 3052 - RNA, 20 nt, Artificial Sequence
  synthetic oligonucleotide
agcucggucugaggccccuc

SEQ ID NO: 3053 - RNA, 14 nt, Artificial Sequence
  synthetic oligonucleotide
ccucagaccgagcu

SEQ ID NO: 3054 - RNA, 23 nt, Artificial Sequence
  synthetic oligonucleotide
ugaggggcagagagcgagacuuu

SEQ ID NO: 3055 - RNA, 20 nt, Artificial Sequence
  synthetic oligonucleotide
ugaggggcagagagcgagac

SEQ ID NO: 3056 - RNA, 14 nt, Artificial Sequence
  synthetic oligonucleotide
cucucugccccuca

SEQ ID NO: 3057 - RNA, 22 nt, Artificial Sequence
  synthetic oligonucleotide
cagcagcaauucauguuuugaa

SEQ ID NO: 3058 - RNA, 20 nt, Artificial Sequence
  synthetic oligonucleotide
cagcagcaauucauguuuug

SEQ ID NO: 3059 - RNA, 14 nt, Artificial Sequence
  synthetic oligonucleotide
augaauugcugcug

SEQ ID NO: 3060 - RNA, 21 nt, Artificial Sequence
  synthetic oligonucleotide
caaaacgugaggcgcugcuau

SEQ ID NO: 3061 - RNA, 20 nt, Artificial Sequence
  synthetic oligonucleotide
caaaacgugaggcgcugcua

SEQ ID NO: 3062 - RNA, 14 nt, Artificial Sequence
  synthetic oligonucleotide
cgccucacguuuug

SEQ ID NO: 3063 - RNA, 23 nt, Artificial Sequence
  synthetic oligonucleotide
aaugacacgaucacucccguuga

SEQ ID NO: 3064 - RNA, 20 nt, Artificial Sequence
  synthetic oligonucleotide
aaugacacgaucacucccgu

SEQ ID NO: 3065 - RNA, 14 nt, Artificial Sequence
  synthetic oligonucleotide
gugaucgugucauu

SEQ ID NO: 3066 - RNA, 22 nt, Artificial Sequence
  synthetic oligonucleotide
aucgggaaugucguguccgccc

SEQ ID NO: 3067 - RNA, 20 nt, Artificial Sequence
  synthetic oligonucleotide
aucgggaaugucguguccgc

SEQ ID NO: 3068 - RNA, 14 nt, Artificial Sequence
  synthetic oligonucleotide
acgacauucccgau

SEQ ID NO: 3069 - RNA, 17 nt, Artificial Sequence
  synthetic oligonucleotide
ccugagaaaagggccaa

SEQ ID NO: 3070 - RNA, 17 nt, Artificial Sequence
  synthetic oligonucleotide
ccugagaaaagggccaa

SEQ ID NO: 3071 - RNA, 14 nt, Artificial Sequence
  synthetic oligonucleotide
gcccuuuucucagg

SEQ ID NO: 3072 - RNA, 19 nt, Artificial Sequence
  synthetic oligonucleotide
ggccacugagucagcacca

SEQ ID NO: 3073 - RNA, 19 nt, Artificial Sequence
  synthetic oligonucleotide
ggccacugagucagcacca

SEQ ID NO: 3074 - RNA, 14 nt, Artificial Sequence
  synthetic oligonucleotide
cugacucaguggcc

SEQ ID NO: 3075 - RNA, 18 nt, Artificial Sequence
  synthetic oligonucleotide
agggcauguccagggggu

SEQ ID NO: 3076 - RNA, 18 nt, Artificial Sequence
  synthetic oligonucleotide
agggcauguccagggggu

SEQ ID NO: 3077 - RNA, 14 nt, Artificial Sequence
  synthetic oligonucleotide
ccuggacaugcccu

SEQ ID NO: 3078 - RNA, 23 nt, Artificial Sequence
  synthetic oligonucleotide
gccuggagcuacuccaccaucuc

SEQ ID NO: 3079 - RNA, 20 nt, Artificial Sequence
  synthetic oligonucleotide
gccuggagcuacuccaccau

SEQ ID NO: 3080 - RNA, 14 nt, Artificial Sequence
  synthetic oligonucleotide
gaguagcuccaggc

SEQ ID NO: 3081 - RNA, 17 nt, Artificial Sequence
  synthetic oligonucleotide
caguguucagagaugga

SEQ ID NO: 3082 - RNA, 17 nt, Artificial Sequence
  synthetic oligonucleotide
caguguucagagaugga

SEQ ID NO: 3083 - RNA, 14 nt, Artificial Sequence
  synthetic oligonucleotide
aucucugaacacug

SEQ ID NO: 3084 - RNA, 18 nt, Artificial Sequence
  synthetic oligonucleotide
aucugaccugaugaaggu

SEQ ID NO: 3085 - RNA, 18 nt, Artificial Sequence
  synthetic oligonucleotide
aucugaccugaugaaggu

SEQ ID NO: 3086 - RNA, 14 nt, Artificial Sequence
  synthetic oligonucleotide
ucaucaggucagau

SEQ ID NO: 3087 - RNA, 18 nt, Artificial Sequence
  synthetic oligonucleotide
ccagagguggggacugag

SEQ ID NO: 3088 - RNA, 18 nt, Artificial Sequence
  synthetic oligonucleotide
ccagagguggggacugag

SEQ ID NO: 3089 - RNA, 14 nt, Artificial Sequence
  synthetic oligonucleotide
guccccaccucugg

SEQ ID NO: 3090 - RNA, 17 nt, Artificial Sequence
  synthetic oligonucleotide
ccccgccaccgccuugg

SEQ ID NO: 3091 - RNA, 17 nt, Artificial Sequence
  synthetic oligonucleotide
ccccgccaccgccuugg

SEQ ID NO: 3092 - RNA, 14 nt, Artificial Sequence
  synthetic oligonucleotide
aggcgguggcgggg

SEQ ID NO: 3093 - RNA, 22 nt, Artificial Sequence
  synthetic oligonucleotide
caguugggucuaggggucagga

SEQ ID NO: 3094 - RNA, 20 nt, Artificial Sequence
  synthetic oligonucleotide
caguugggucuaggggucag

SEQ ID NO: 3095 - RNA, 14 nt, Artificial Sequence
  synthetic oligonucleotide
ccuagacccaacug

SEQ ID NO: 3096 - RNA, 19 nt, Artificial Sequence
  synthetic oligonucleotide
cuuggggcauggaguccca

SEQ ID NO: 3097 - RNA, 19 nt, Artificial Sequence
  synthetic oligonucleotide
cuuggggcauggaguccca

SEQ ID NO: 3098 - RNA, 14 nt, Artificial Sequence
  synthetic oligonucleotide
cuccaugccccaag

SEQ ID NO: 3099 - RNA, 16 nt, Artificial Sequence
  synthetic oligonucleotide
aggaaacagggaccca

SEQ ID NO: 3100 - RNA, 16 nt, Artificial Sequence
  synthetic oligonucleotide
aggaaacagggaccca

SEQ ID NO: 3101 - RNA, 14 nt, Artificial Sequence
  synthetic oligonucleotide
ggucccuguuuccu

SEQ ID NO: 3102 - RNA, 17 nt, Artificial Sequence
  synthetic oligonucleotide
gacauucagacuaccug

SEQ ID NO: 3103 - RNA, 17 nt, Artificial Sequence
  synthetic oligonucleotide
gacauucagacuaccug

SEQ ID NO: 3104 - RNA, 14 nt, Artificial Sequence
  synthetic oligonucleotide
guagucugaauguc

SEQ ID NO: 3105 - RNA, 18 nt, Artificial Sequence
  synthetic oligonucleotide
auucuaagugccuuggcc

SEQ ID NO: 3106 - RNA, 18 nt, Artificial Sequence
  synthetic oligonucleotide
auucuaagugccuuggcc

SEQ ID NO: 3107 - RNA, 14 nt, Artificial Sequence
  synthetic oligonucleotide
aaggcacuuagaau

SEQ ID NO: 3108 - RNA, 17 nt, Artificial Sequence
  synthetic oligonucleotide
acucagucauggucauu

SEQ ID NO: 3109 - RNA, 17 nt, Artificial Sequence
  synthetic oligonucleotide
acucagucauggucauu

SEQ ID NO: 3110 - RNA, 14 nt, Artificial Sequence
  synthetic oligonucleotide
gaccaugacugagu

SEQ ID NO: 3111 - RNA, 19 nt, Artificial Sequence
  synthetic oligonucleotide
cugugggcucagcucuggg

SEQ ID NO: 3112 - RNA, 19 nt, Artificial Sequence
  synthetic oligonucleotide
cugugggcucagcucuggg

SEQ ID NO: 3113 - RNA, 14 nt, Artificial Sequence
  synthetic oligonucleotide
agcugagcccacag

SEQ ID NO: 3114 - RNA, 16 nt, Artificial Sequence
  synthetic oligonucleotide
cuaggaggccuuggcc

SEQ ID NO: 3115 - RNA, 16 nt, Artificial Sequence
  synthetic oligonucleotide
cuaggaggccuuggcc

SEQ ID NO: 3116 - RNA, 14 nt, Artificial Sequence
  synthetic oligonucleotide
ccaaggccuccuag

SEQ ID NO: 3117 - RNA, 16 nt, Artificial Sequence
  synthetic oligonucleotide
uccagcucgguggcac

SEQ ID NO: 3118 - RNA, 16 nt, Artificial Sequence
  synthetic oligonucleotide
uccagcucgguggcac

SEQ ID NO: 3119 - RNA, 14 nt, Artificial Sequence
  synthetic oligonucleotide
gccaccgagcugga

SEQ ID NO: 3120 - RNA, 21 nt, Artificial Sequence
  synthetic oligonucleotide
ggcuccuccucucaggaugug

SEQ ID NO: 3121 - RNA, 20 nt, Artificial Sequence
  synthetic oligonucleotide
ggcuccuccucucaggaugu

SEQ ID NO: 3122 - RNA, 14 nt, Artificial Sequence
  synthetic oligonucleotide
ugagaggaggagcc

SEQ ID NO: 3123 - RNA, 21 nt, Artificial Sequence
  synthetic oligonucleotide
gcaggcacagacagcccuggc

SEQ ID NO: 3124 - RNA, 20 nt, Artificial Sequence
  synthetic oligonucleotide
gcaggcacagacagcccugg

SEQ ID NO: 3125 - RNA, 14 nt, Artificial Sequence
  synthetic oligonucleotide
cugucugugccugc

SEQ ID NO: 3126 - RNA, 20 nt, Artificial Sequence
  synthetic oligonucleotide
ucagggagucaggggagggc

SEQ ID NO: 3127 - RNA, 20 nt, Artificial Sequence
  synthetic oligonucleotide
ucagggagucaggggagggc

SEQ ID NO: 3128 - RNA, 14 nt, Artificial Sequence
  synthetic oligonucleotide
cccugacucccuga

SEQ ID NO: 3129 - RNA, 19 nt, Artificial Sequence
  synthetic oligonucleotide
gggggaagaaaaggugggg

SEQ ID NO: 3130 - RNA, 19 nt, Artificial Sequence
  synthetic oligonucleotide
gggggaagaaaaggugggg

SEQ ID NO: 3131 - RNA, 14 nt, Artificial Sequence
  synthetic oligonucleotide
ccuuuucuuccccc

SEQ ID NO: 3132 - RNA, 18 nt, Artificial Sequence
  synthetic oligonucleotide
cauucaacuagugauugu

SEQ ID NO: 3133 - RNA, 18 nt, Artificial Sequence
  synthetic oligonucleotide
cauucaacuagugauugu

SEQ ID NO: 3134 - RNA, 14 nt, Artificial Sequence
  synthetic oligonucleotide
ucacuaguugaaug

SEQ ID NO: 3135 - RNA, 18 nt, Artificial Sequence
  synthetic oligonucleotide
guguucucugauggacag

SEQ ID NO: 3136 - RNA, 18 nt, Artificial Sequence
  synthetic oligonucleotide
guguucucugauggacag

SEQ ID NO: 3137 - RNA, 14 nt, Artificial Sequence
  synthetic oligonucleotide
ccaucagagaacac

SEQ ID NO: 3138 - RNA, 18 nt, Artificial Sequence
  synthetic oligonucleotide
cagcagucccucccccug

SEQ ID NO: 3139 - RNA, 18 nt, Artificial Sequence
  synthetic oligonucleotide
cagcagucccucccccug

SEQ ID NO: 3140 - RNA, 14 nt, Artificial Sequence
  synthetic oligonucleotide
gggagggacugcug

SEQ ID NO: 3141 - RNA, 17 nt, Artificial Sequence
  synthetic oligonucleotide
ccaauuaccacuucuuu

SEQ ID NO: 3142 - RNA, 17 nt, Artificial Sequence
  synthetic oligonucleotide
ccaauuaccacuucuuu

SEQ ID NO: 3143 - RNA, 14 nt, Artificial Sequence
  synthetic oligonucleotide
gaagugguaauugg

SEQ ID NO: 3144 - RNA, 17 nt, Artificial Sequence
  synthetic oligonucleotide
cucagugacucaugugc

SEQ ID NO: 3145 - RNA, 17 nt, Artificial Sequence
  synthetic oligonucleotide
cucagugacucaugugc

SEQ ID NO: 3146 - RNA, 14 nt, Artificial Sequence
  synthetic oligonucleotide
caugagucacugag

SEQ ID NO: 3147 - RNA, 21 nt, Artificial Sequence
  synthetic oligonucleotide
gcaguucugagcacaguacac

SEQ ID NO: 3148 - RNA, 20 nt, Artificial Sequence
  synthetic oligonucleotide
gcaguucugagcacaguaca

SEQ ID NO: 3149 - RNA, 14 nt, Artificial Sequence
  synthetic oligonucleotide
gugcucagaacugc

SEQ ID NO: 3150 - RNA, 18 nt, Artificial Sequence
  synthetic oligonucleotide
cuaggggguuugcccuug

SEQ ID NO: 3151 - RNA, 18 nt, Artificial Sequence
  synthetic oligonucleotide
cuaggggguuugcccuug

SEQ ID NO: 3152 - RNA, 14 nt, Artificial Sequence
  synthetic oligonucleotide
ggcaaacccccuag

SEQ ID NO: 3153 - RNA, 16 nt, Artificial Sequence
  synthetic oligonucleotide
cucuccucccggcuuc

SEQ ID NO: 3154 - RNA, 16 nt, Artificial Sequence
  synthetic oligonucleotide
cucuccucccggcuuc

SEQ ID NO: 3155 - RNA, 14 nt, Artificial Sequence
  synthetic oligonucleotide
agccgggaggagag

SEQ ID NO: 3156 - RNA, 21 nt, Artificial Sequence
  synthetic oligonucleotide
gaguguaguucugagcagagc

SEQ ID NO: 3157 - RNA, 20 nt, Artificial Sequence
  synthetic oligonucleotide
gaguguaguucugagcagag

SEQ ID NO: 3158 - RNA, 14 nt, Artificial Sequence
  synthetic oligonucleotide
ucagaacuacacuc

SEQ ID NO: 3159 - RNA, 18 nt, Artificial Sequence
  synthetic oligonucleotide
gggucccggggagggggg

SEQ ID NO: 3160 - RNA, 18 nt, Artificial Sequence
  synthetic oligonucleotide
gggucccggggagggggg

SEQ ID NO: 3161 - RNA, 14 nt, Artificial Sequence
  synthetic oligonucleotide
ccuccccgggaccc

SEQ ID NO: 3162 - RNA, 18 nt, Artificial Sequence
  synthetic oligonucleotide
uaaaauuugcauccagga

SEQ ID NO: 3163 - RNA, 18 nt, Artificial Sequence
  synthetic oligonucleotide
uaaaauuugcauccagga

SEQ ID NO: 3164 - RNA, 14 nt, Artificial Sequence
  synthetic oligonucleotide
ggaugcaaauuuua

SEQ ID NO: 3165 - RNA, 17 nt, Artificial Sequence
  synthetic oligonucleotide
uggggcucagcgaguuu

SEQ ID NO: 3166 - RNA, 17 nt, Artificial Sequence
  synthetic oligonucleotide
uggggcucagcgaguuu

SEQ ID NO: 3167 - RNA, 14 nt, Artificial Sequence
  synthetic oligonucleotide
cucgcugagcccca

SEQ ID NO: 3168 - RNA, 18 nt, Artificial Sequence
  synthetic oligonucleotide
gggcucacaucaccccau

SEQ ID NO: 3169 - RNA, 18 nt, Artificial Sequence
  synthetic oligonucleotide
gggcucacaucaccccau

SEQ ID NO: 3170 - RNA, 14 nt, Artificial Sequence
  synthetic oligonucleotide
ggugaugugagccc

SEQ ID NO: 3171 - RNA, 18 nt, Artificial Sequence
  synthetic oligonucleotide
gcggcgaguccgacucau

SEQ ID NO: 3172 - RNA, 18 nt, Artificial Sequence
  synthetic oligonucleotide
gcggcgaguccgacucau

SEQ ID NO: 3173 - RNA, 14 nt, Artificial Sequence
  synthetic oligonucleotide
gucggacucgccgc

SEQ ID NO: 3174 - RNA, 17 nt, Artificial Sequence
  synthetic oligonucleotide
accccacuccugguacc

SEQ ID NO: 3175 - RNA, 17 nt, Artificial Sequence
  synthetic oligonucleotide
accccacuccugguacc

SEQ ID NO: 3176 - RNA, 14 nt, Artificial Sequence
  synthetic oligonucleotide
accaggaguggggu

SEQ ID NO: 3177 - RNA, 19 nt, Artificial Sequence
  synthetic oligonucleotide
ucucccuugagggcacuuu

SEQ ID NO: 3178 - RNA, 19 nt, Artificial Sequence
  synthetic oligonucleotide
ucucccuugagggcacuuu

SEQ ID NO: 3179 - RNA, 14 nt, Artificial Sequence
  synthetic oligonucleotide
gcccucaagggaga

SEQ ID NO: 3180 - RNA, 17 nt, Artificial Sequence
  synthetic oligonucleotide
uugucugcugaguuucc

SEQ ID NO: 3181 - RNA, 17 nt, Artificial Sequence
  synthetic oligonucleotide
uugucugcugaguuucc

SEQ ID NO: 3182 - RNA, 14 nt, Artificial Sequence
  synthetic oligonucleotide
aacucagcagacaa

SEQ ID NO: 3183 - RNA, 19 nt, Artificial Sequence
  synthetic oligonucleotide
gcauugugcagggcuauca

SEQ ID NO: 3184 - RNA, 19 nt, Artificial Sequence
  synthetic oligonucleotide
gcauugugcagggcuauca

SEQ ID NO: 3185 - RNA, 14 nt, Artificial Sequence
  synthetic oligonucleotide
gcccugcacaaugc

SEQ ID NO: 3186 - RNA, 22 nt, Artificial Sequence
  synthetic oligonucleotide
uaauacugucugguaaaaccgu

SEQ ID NO: 3187 - RNA, 20 nt, Artificial Sequence
  synthetic oligonucleotide
uaauacugucugguaaaacc

SEQ ID NO: 3188 - RNA, 14 nt, Artificial Sequence
  synthetic oligonucleotide
accagacaguauua

SEQ ID NO: 3189 - RNA, 19 nt, Artificial Sequence
  synthetic oligonucleotide
ugcccuccuuucuucccuc

SEQ ID NO: 3190 - RNA, 19 nt, Artificial Sequence
  synthetic oligonucleotide
ugcccuccuuucuucccuc

SEQ ID NO: 3191 - RNA, 14 nt, Artificial Sequence
  synthetic oligonucleotide
aagaaaggagggca

SEQ ID NO: 3192 - RNA, 16 nt, Artificial Sequence
  synthetic oligonucleotide
uucagcaggaacagcu

SEQ ID NO: 3193 - RNA, 16 nt, Artificial Sequence
  synthetic oligonucleotide
uucagcaggaacagcu

SEQ ID NO: 3194 - RNA, 14 nt, Artificial Sequence
  synthetic oligonucleotide
cuguuccugcugaa

SEQ ID NO: 3195 - RNA, 18 nt, Artificial Sequence
  synthetic oligonucleotide
ccccugggccggccuugg

SEQ ID NO: 3196 - RNA, 18 nt, Artificial Sequence
  synthetic oligonucleotide
ccccugggccggccuugg

SEQ ID NO: 3197 - RNA, 14 nt, Artificial Sequence
  synthetic oligonucleotide
ggccggcccagggg

SEQ ID NO: 3198 - RNA, 17 nt, Artificial Sequence
  synthetic oligonucleotide
cagccugacaggaacag

SEQ ID NO: 3199 - RNA, 17 nt, Artificial Sequence
  synthetic oligonucleotide
cagccugacaggaacag

SEQ ID NO: 3200 - RNA, 14 nt, Artificial Sequence
  synthetic oligonucleotide
uuccugucaggcug

SEQ ID NO: 3201 - RNA, 17 nt, Artificial Sequence
  synthetic oligonucleotide
gggagucuacagcaggg

SEQ ID NO: 3202 - RNA, 17 nt, Artificial Sequence
  synthetic oligonucleotide
gggagucuacagcaggg

SEQ ID NO: 3203 - RNA, 14 nt, Artificial Sequence
  synthetic oligonucleotide
ugcuguagacuccc

SEQ ID NO: 3204 - RNA, 18 nt, Artificial Sequence
  synthetic oligonucleotide
cagugcaauguuuuccuu

SEQ ID NO: 3205 - RNA, 18 nt, Artificial Sequence
  synthetic oligonucleotide
cagugcaauguuuuccuu

SEQ ID NO: 3206 - RNA, 14 nt, Artificial Sequence
  synthetic oligonucleotide
aaaacauugcacug

SEQ ID NO: 3207 - RNA, 17 nt, Artificial Sequence
  synthetic oligonucleotide
augugggcucaggcuca

SEQ ID NO: 3208 - RNA, 17 nt, Artificial Sequence
  synthetic oligonucleotide
augugggcucaggcuca

SEQ ID NO: 3209 - RNA, 14 nt, Artificial Sequence
  synthetic oligonucleotide
gccugagcccacau

SEQ ID NO: 3210 - RNA, 16 nt, Artificial Sequence
  synthetic oligonucleotide
ugccuuccugucugug

SEQ ID NO: 3211 - RNA, 16 nt, Artificial Sequence
  synthetic oligonucleotide
ugccuuccugucugug

SEQ ID NO: 3212 - RNA, 14 nt, Artificial Sequence
  synthetic oligonucleotide
cagacaggaaggca

SEQ ID NO: 3213 - RNA, 22 nt, Artificial Sequence
  synthetic oligonucleotide
cugggacaggaggaggaggcag

SEQ ID NO: 3214 - RNA, 20 nt, Artificial Sequence
  synthetic oligonucleotide
cugggacaggaggaggaggc

SEQ ID NO: 3215 - RNA, 14 nt, Artificial Sequence
  synthetic oligonucleotide
uccuccugucccag

SEQ ID NO: 3216 - RNA, 18 nt, Artificial Sequence
  synthetic oligonucleotide
gcuggugacaugagaggc

SEQ ID NO: 3217 - RNA, 18 nt, Artificial Sequence
  synthetic oligonucleotide
gcuggugacaugagaggc

SEQ ID NO: 3218 - RNA, 14 nt, Artificial Sequence
  synthetic oligonucleotide
cucaugucaccagc

SEQ ID NO: 3219 - RNA, 18 nt, Artificial Sequence
  synthetic oligonucleotide
ugggagcuggacuacuuc

SEQ ID NO: 3220 - RNA, 18 nt, Artificial Sequence
  synthetic oligonucleotide
ugggagcuggacuacuuc

SEQ ID NO: 3221 - RNA, 14 nt, Artificial Sequence
  synthetic oligonucleotide
uaguccagcuccca

SEQ ID NO: 3222 - RNA, 20 nt, Artificial Sequence
  synthetic oligonucleotide
ucccacuacuucacuuguga

SEQ ID NO: 3223 - RNA, 20 nt, Artificial Sequence
  synthetic oligonucleotide
ucccacuacuucacuuguga

SEQ ID NO: 3224 - RNA, 14 nt, Artificial Sequence
  synthetic oligonucleotide
gugaaguaguggga

SEQ ID NO: 3225 - RNA, 18 nt, Artificial Sequence
  synthetic oligonucleotide
ccaguguggcucagcgag

SEQ ID NO: 3226 - RNA, 18 nt, Artificial Sequence
  synthetic oligonucleotide
ccaguguggcucagcgag

SEQ ID NO: 3227 - RNA, 14 nt, Artificial Sequence
  synthetic oligonucleotide
cugagccacacugg

SEQ ID NO: 3228 - RNA, 17 nt, Artificial Sequence
  synthetic oligonucleotide
uucugagcugaggacag

SEQ ID NO: 3229 - RNA, 17 nt, Artificial Sequence
  synthetic oligonucleotide
uucugagcugaggacag

SEQ ID NO: 3230 - RNA, 14 nt, Artificial Sequence
  synthetic oligonucleotide
uccucagcucagaa

SEQ ID NO: 3231 - RNA, 17 nt, Artificial Sequence
  synthetic oligonucleotide
ccggcauguccagggca

SEQ ID NO: 3232 - RNA, 17 nt, Artificial Sequence
  synthetic oligonucleotide
ccggcauguccagggca

SEQ ID NO: 3233 - RNA, 14 nt, Artificial Sequence
  synthetic oligonucleotide
ccuggacaugccgg

SEQ ID NO: 3234 - RNA, 18 nt, Artificial Sequence
  synthetic oligonucleotide
ccuagacaccuccaguuc

SEQ ID NO: 3235 - RNA, 18 nt, Artificial Sequence
  synthetic oligonucleotide
ccuagacaccuccaguuc

SEQ ID NO: 3236 - RNA, 14 nt, Artificial Sequence
  synthetic oligonucleotide
uggaggugucuagg

SEQ ID NO: 3237 - RNA, 17 nt, Artificial Sequence
  synthetic oligonucleotide
uggagagaaaggcagua

SEQ ID NO: 3238 - RNA, 17 nt, Artificial Sequence
  synthetic oligonucleotide
uggagagaaaggcagua

SEQ ID NO: 3239 - RNA, 14 nt, Artificial Sequence
  synthetic oligonucleotide
ugccuuucucucca

SEQ ID NO: 3240 - RNA, 19 nt, Artificial Sequence
  synthetic oligonucleotide
aauguuuuuuccuguuucc

SEQ ID NO: 3241 - RNA, 19 nt, Artificial Sequence
  synthetic oligonucleotide
aauguuuuuuccuguuucc

SEQ ID NO: 3242 - RNA, 14 nt, Artificial Sequence
  synthetic oligonucleotide
caggaaaaaacauu

SEQ ID NO: 3243 - RNA, 18 nt, Artificial Sequence
  synthetic oligonucleotide
ucccuggaguuucuucuu

SEQ ID NO: 3244 - RNA, 18 nt, Artificial Sequence
  synthetic oligonucleotide
ucccuggaguuucuucuu

SEQ ID NO: 3245 - RNA, 14 nt, Artificial Sequence
  synthetic oligonucleotide
agaaacuccaggga

SEQ ID NO: 3246 - RNA, 18 nt, Artificial Sequence
  synthetic oligonucleotide
cuggagucuaggauucca

SEQ ID NO: 3247 - RNA, 18 nt, Artificial Sequence
  synthetic oligonucleotide
cuggagucuaggauucca

SEQ ID NO: 3248 - RNA, 14 nt, Artificial Sequence
  synthetic oligonucleotide
auccuagacuccag

SEQ ID NO: 3249 - RNA, 21 nt, Artificial Sequence
  synthetic oligonucleotide
ugucuugcaggccgucaugca

SEQ ID NO: 3250 - RNA, 20 nt, Artificial Sequence
  synthetic oligonucleotide
ugucuugcaggccgucaugc

SEQ ID NO: 3251 - RNA, 14 nt, Artificial Sequence
  synthetic oligonucleotide
cggccugcaagaca

SEQ ID NO: 3252 - RNA, 22 nt, Artificial Sequence
  synthetic oligonucleotide
caggucgucuugcagggcuucu

SEQ ID NO: 3253 - RNA, 20 nt, Artificial Sequence
  synthetic oligonucleotide
caggucgucuugcagggcuu

SEQ ID NO: 3254 - RNA, 14 nt, Artificial Sequence
  synthetic oligonucleotide
ugcaagacgaccug

SEQ ID NO: 3255 - RNA, 16 nt, Artificial Sequence
  synthetic oligonucleotide
gcagcauucauguccc

SEQ ID NO: 3256 - RNA, 16 nt, Artificial Sequence
  synthetic oligonucleotide
gcagcauucauguccc

SEQ ID NO: 3257 - RNA, 14 nt, Artificial Sequence
  synthetic oligonucleotide
gacaugaaugcugc

SEQ ID NO: 3258 - RNA, 18 nt, Artificial Sequence
  synthetic oligonucleotide
gaaagagagcugagugug

SEQ ID NO: 3259 - RNA, 18 nt, Artificial Sequence
  synthetic oligonucleotide
gaaagagagcugagugug

SEQ ID NO: 3260 - RNA, 14 nt, Artificial Sequence
  synthetic oligonucleotide
cucagcucucuuuc

SEQ ID NO: 3261 - RNA, 19 nt, Artificial Sequence
  synthetic oligonucleotide
ggccuuguuccugucccca

SEQ ID NO: 3262 - RNA, 19 nt, Artificial Sequence
  synthetic oligonucleotide
ggccuuguuccugucccca

SEQ ID NO: 3263 - RNA, 14 nt, Artificial Sequence
  synthetic oligonucleotide
acaggaacaaggcc

SEQ ID NO: 3264 - RNA, 20 nt, Artificial Sequence
  synthetic oligonucleotide
agcccccuggccccaaaccc

SEQ ID NO: 3265 - RNA, 20 nt, Artificial Sequence
  synthetic oligonucleotide
agcccccuggccccaaaccc

SEQ ID NO: 3266 - RNA, 14 nt, Artificial Sequence
  synthetic oligonucleotide
ggggccagggggcu

SEQ ID NO: 3267 - RNA, 18 nt, Artificial Sequence
  synthetic oligonucleotide
cucugggaaaugggacag

SEQ ID NO: 3268 - RNA, 18 nt, Artificial Sequence
  synthetic oligonucleotide
cucugggaaaugggacag

SEQ ID NO: 3269 - RNA, 14 nt, Artificial Sequence
  synthetic oligonucleotide
cccauuucccagag

SEQ ID NO: 3270 - RNA, 18 nt, Artificial Sequence
  synthetic oligonucleotide
ccgcuuucugagcuggac

SEQ ID NO: 3271 - RNA, 18 nt, Artificial Sequence
  synthetic oligonucleotide
ccgcuuucugagcuggac

SEQ ID NO: 3272 - RNA, 14 nt, Artificial Sequence
  synthetic oligonucleotide
agcucagaaagcgg

SEQ ID NO: 3273 - RNA, 17 nt, Artificial Sequence
  synthetic oligonucleotide
ggugaggcuagcuggug

SEQ ID NO: 3274 - RNA, 17 nt, Artificial Sequence
  synthetic oligonucleotide
ggugaggcuagcuggug

SEQ ID NO: 3275 - RNA, 14 nt, Artificial Sequence
  synthetic oligonucleotide
cagcuagccucacc

SEQ ID NO: 3276 - RNA, 17 nt, Artificial Sequence
  synthetic oligonucleotide
acauugccagggaguuu

SEQ ID NO: 3277 - RNA, 17 nt, Artificial Sequence
  synthetic oligonucleotide
acauugccagggaguuu

SEQ ID NO: 3278 - RNA, 14 nt, Artificial Sequence
  synthetic oligonucleotide
cucccuggcaaugu

SEQ ID NO: 3279 - RNA, 17 nt, Artificial Sequence
  synthetic oligonucleotide
cacuguggguacaugcu

SEQ ID NO: 3280 - RNA, 17 nt, Artificial Sequence
  synthetic oligonucleotide
cacuguggguacaugcu

SEQ ID NO: 3281 - RNA, 14 nt, Artificial Sequence
  synthetic oligonucleotide
auguacccacagug

SEQ ID NO: 3282 - RNA, 17 nt, Artificial Sequence
  synthetic oligonucleotide
ucccugagcaaagccac

SEQ ID NO: 3283 - RNA, 17 nt, Artificial Sequence
  synthetic oligonucleotide
ucccugagcaaagccac

SEQ ID NO: 3284 - RNA, 14 nt, Artificial Sequence
  synthetic oligonucleotide
gcuuugcucaggga

SEQ ID NO: 3285 - RNA, 23 nt, Artificial Sequence
  synthetic oligonucleotide
ucuuggaguaggucauugggugg

SEQ ID NO: 3286 - RNA, 20 nt, Artificial Sequence
  synthetic oligonucleotide
ucuuggaguaggucauuggg

SEQ ID NO: 3287 - RNA, 14 nt, Artificial Sequence
  synthetic oligonucleotide
gaccuacuccaaga

SEQ ID NO: 3288 - RNA, 21 nt, Artificial Sequence
  synthetic oligonucleotide
cuggauggcuccuccaugucu

SEQ ID NO: 3289 - RNA, 20 nt, Artificial Sequence
  synthetic oligonucleotide
cuggauggcuccuccauguc

SEQ ID NO: 3290 - RNA, 14 nt, Artificial Sequence
  synthetic oligonucleotide
gaggagccauccag

SEQ ID NO: 3291 - RNA, 18 nt, Artificial Sequence
  synthetic oligonucleotide
gggauucuguagcuuccu

SEQ ID NO: 3292 - RNA, 18 nt, Artificial Sequence
  synthetic oligonucleotide
gggauucuguagcuuccu

SEQ ID NO: 3293 - RNA, 14 nt, Artificial Sequence
  synthetic oligonucleotide
agcuacagaauccc

SEQ ID NO: 3294 - RNA, 21 nt, Artificial Sequence
  synthetic oligonucleotide
uuagcgguggaccgcccugcg

SEQ ID NO: 3295 - RNA, 20 nt, Artificial Sequence
  synthetic oligonucleotide
uuagcgguggaccgcccugc

SEQ ID NO: 3296 - RNA, 14 nt, Artificial Sequence
  synthetic oligonucleotide
cgguccaccgcuaa

SEQ ID NO: 3297 - RNA, 21 nt, Artificial Sequence
  synthetic oligonucleotide
cugugggcucagcgcgugggg

SEQ ID NO: 3298 - RNA, 20 nt, Artificial Sequence
  synthetic oligonucleotide
cugugggcucagcgcguggg

SEQ ID NO: 3299 - RNA, 14 nt, Artificial Sequence
  synthetic oligonucleotide
cgcugagcccacag

SEQ ID NO: 3300 - RNA, 18 nt, Artificial Sequence
  synthetic oligonucleotide
cagccccacagccucaga

SEQ ID NO: 3301 - RNA, 18 nt, Artificial Sequence
  synthetic oligonucleotide
cagccccacagccucaga

SEQ ID NO: 3302 - RNA, 14 nt, Artificial Sequence
  synthetic oligonucleotide
aggcuguggggcug

SEQ ID NO: 3303 - RNA, 20 nt, Artificial Sequence
  synthetic oligonucleotide
cccugagacccuaaccuuaa

SEQ ID NO: 3304 - RNA, 20 nt, Artificial Sequence
  synthetic oligonucleotide
cccugagacccuaaccuuaa

SEQ ID NO: 3305 - RNA, 14 nt, Artificial Sequence
  synthetic oligonucleotide
uuagggucucaggg

SEQ ID NO: 3306 - RNA, 18 nt, Artificial Sequence
  synthetic oligonucleotide
uugcacuugucucaguga

SEQ ID NO: 3307 - RNA, 18 nt, Artificial Sequence
  synthetic oligonucleotide
uugcacuugucucaguga

SEQ ID NO: 3308 - RNA, 14 nt, Artificial Sequence
  synthetic oligonucleotide
ugagacaagugcaa

SEQ ID NO: 3309 - RNA, 20 nt, Artificial Sequence
  synthetic oligonucleotide
uguuccucugucucccagac

SEQ ID NO: 3310 - RNA, 20 nt, Artificial Sequence
  synthetic oligonucleotide
uguuccucugucucccagac

SEQ ID NO: 3311 - RNA, 14 nt, Artificial Sequence
  synthetic oligonucleotide
gagacagaggaaca

SEQ ID NO: 3312 - RNA, 19 nt, Artificial Sequence
  synthetic oligonucleotide
ggcuugcaugggggacugg

SEQ ID NO: 3313 - RNA, 19 nt, Artificial Sequence
  synthetic oligonucleotide
ggcuugcaugggggacugg

SEQ ID NO: 3314 - RNA, 14 nt, Artificial Sequence
  synthetic oligonucleotide
cccccaugcaagcc

SEQ ID NO: 3315 - RNA, 17 nt, Artificial Sequence
  synthetic oligonucleotide
ccaguuuucccaggauu

SEQ ID NO: 3316 - RNA, 17 nt, Artificial Sequence
  synthetic oligonucleotide
ccaguuuucccaggauu

SEQ ID NO: 3317 - RNA, 14 nt, Artificial Sequence
  synthetic oligonucleotide
ccugggaaaacugg

SEQ ID NO: 3318 - RNA, 19 nt, Artificial Sequence
  synthetic oligonucleotide
ccugagacccuaguuccac

SEQ ID NO: 3319 - RNA, 19 nt, Artificial Sequence
  synthetic oligonucleotide
ccugagacccuaguuccac

SEQ ID NO: 3320 - RNA, 14 nt, Artificial Sequence
  synthetic oligonucleotide
acuagggucucagg

SEQ ID NO: 3321 - RNA, 22 nt, Artificial Sequence
  synthetic oligonucleotide
aucaugaugggcuccucggugu

SEQ ID NO: 3322 - RNA, 20 nt, Artificial Sequence
  synthetic oligonucleotide
aucaugaugggcuccucggu

SEQ ID NO: 3323 - RNA, 14 nt, Artificial Sequence
  synthetic oligonucleotide
gagcccaucaugau

SEQ ID NO: 3324 - RNA, 19 nt, Artificial Sequence
  synthetic oligonucleotide
ccucagaucagagccuugc

SEQ ID NO: 3325 - RNA, 19 nt, Artificial Sequence
  synthetic oligonucleotide
ccucagaucagagccuugc

SEQ ID NO: 3326 - RNA, 14 nt, Artificial Sequence
  synthetic oligonucleotide
gcucugaucugagg

SEQ ID NO: 3327 - RNA, 22 nt, Artificial Sequence
  synthetic oligonucleotide
uugcauauguaggaugucccau

SEQ ID NO: 3328 - RNA, 20 nt, Artificial Sequence
  synthetic oligonucleotide
uugcauauguaggauguccc

SEQ ID NO: 3329 - RNA, 14 nt, Artificial Sequence
  synthetic oligonucleotide
uccuacauaugcaa

SEQ ID NO: 3330 - RNA, 22 nt, Artificial Sequence
  synthetic oligonucleotide
uggcaguguauuguuagcuggu

SEQ ID NO: 3331 - RNA, 20 nt, Artificial Sequence
  synthetic oligonucleotide
uggcaguguauuguuagcug

SEQ ID NO: 3332 - RNA, 14 nt, Artificial Sequence
  synthetic oligonucleotide
acaauacacugcca

SEQ ID NO: 3333 - RNA, 22 nt, Artificial Sequence
  synthetic oligonucleotide
aggcaguguauuguuagcuggc

SEQ ID NO: 3334 - RNA, 20 nt, Artificial Sequence
  synthetic oligonucleotide
aggcaguguauuguuagcug

SEQ ID NO: 3335 - RNA, 14 nt, Artificial Sequence
  synthetic oligonucleotide
acaauacacugccu

SEQ ID NO: 3336 - RNA, 22 nt, Artificial Sequence
  synthetic oligonucleotide
cagccacaacuacccugccacu

SEQ ID NO: 3337 - RNA, 20 nt, Artificial Sequence
  synthetic oligonucleotide
cagccacaacuacccugcca

SEQ ID NO: 3338 - RNA, 14 nt, Artificial Sequence
  synthetic oligonucleotide
gguaguuguggcug

SEQ ID NO: 3339 - RNA, 25 nt, Artificial Sequence
  synthetic oligonucleotide
uaggcaguguauugcuagcggcugu

SEQ ID NO: 3340 - RNA, 20 nt, Artificial Sequence
  synthetic oligonucleotide
uaggcaguguauugcuagcg

SEQ ID NO: 3341 - RNA, 14 nt, Artificial Sequence
  synthetic oligonucleotide
caauacacugccua

SEQ ID NO: 3342 - RNA, 23 nt, Artificial Sequence
  synthetic oligonucleotide
uugcuaguugcacuccucucugu

SEQ ID NO: 3343 - RNA, 20 nt, Artificial Sequence
  synthetic oligonucleotide
uugcuaguugcacuccucuc

SEQ ID NO: 3344 - RNA, 14 nt, Artificial Sequence
  synthetic oligonucleotide
agugcaacuagcaa

SEQ ID NO: 3345 - RNA, 22 nt, Artificial Sequence
  synthetic oligonucleotide
uuuugcgauguguuccuaauau

SEQ ID NO: 3346 - RNA, 20 nt, Artificial Sequence
  synthetic oligonucleotide
uuuugcgauguguuccuaau

SEQ ID NO: 3347 - RNA, 14 nt, Artificial Sequence
  synthetic oligonucleotide
aacacaucgcaaaa

SEQ ID NO: 3348 - RNA, 22 nt, Artificial Sequence
  synthetic oligonucleotide
uugggaucauuuugcauccaua

SEQ ID NO: 3349 - RNA, 20 nt, Artificial Sequence
  synthetic oligonucleotide
uugggaucauuuugcaucca

SEQ ID NO: 3350 - RNA, 14 nt, Artificial Sequence
  synthetic oligonucleotide
caaaaugaucccaa

SEQ ID NO: 3351 - RNA, 22 nt, Artificial Sequence
  synthetic oligonucleotide
uuuugcaauauguuccugaaua

SEQ ID NO: 3352 - RNA, 20 nt, Artificial Sequence
  synthetic oligonucleotide
uuuugcaauauguuccugaa

SEQ ID NO: 3353 - RNA, 14 nt, Artificial Sequence
  synthetic oligonucleotide
aacauauugcaaaa

SEQ ID NO: 3354 - RNA, 22 nt, Artificial Sequence
  synthetic oligonucleotide
aaaccguuaccauuacugaguu

SEQ ID NO: 3355 - RNA, 20 nt, Artificial Sequence
  synthetic oligonucleotide
aaaccguuaccauuacugag

SEQ ID NO: 3356 - RNA, 14 nt, Artificial Sequence
  synthetic oligonucleotide
aaugguaacgguuu

SEQ ID NO: 3357 - RNA, 22 nt, Artificial Sequence
  synthetic oligonucleotide
aacuguuugcagaggaaacuga

SEQ ID NO: 3358 - RNA, 20 nt, Artificial Sequence
  synthetic oligonucleotide
aacuguuugcagaggaaacu

SEQ ID NO: 3359 - RNA, 14 nt, Artificial Sequence
  synthetic oligonucleotide
cucugcaaacaguu

SEQ ID NO: 3360 - RNA, 22 nt, Artificial Sequence
  synthetic oligonucleotide
cucaucugcaaagaaguaagug

SEQ ID NO: 3361 - RNA, 20 nt, Artificial Sequence
  synthetic oligonucleotide
cucaucugcaaagaaguaag

SEQ ID NO: 3362 - RNA, 14 nt, Artificial Sequence
  synthetic oligonucleotide
ucuuugcagaugag

SEQ ID NO: 3363 - RNA, 23 nt, Artificial Sequence
  synthetic oligonucleotide
uagugcaauauugcuuauagggu

SEQ ID NO: 3364 - RNA, 20 nt, Artificial Sequence
  synthetic oligonucleotide
uagugcaauauugcuuauag

SEQ ID NO: 3365 - RNA, 14 nt, Artificial Sequence
  synthetic oligonucleotide
gcaauauugcacua

SEQ ID NO: 3366 - RNA, 22 nt, Artificial Sequence
  synthetic oligonucleotide
acccuaucaauauugucucugc

SEQ ID NO: 3367 - RNA, 20 nt, Artificial Sequence
  synthetic oligonucleotide
acccuaucaauauugucucu

SEQ ID NO: 3368 - RNA, 14 nt, Artificial Sequence
  synthetic oligonucleotide
aauauugauagggu

SEQ ID NO: 3369 - RNA, 21 nt, Artificial Sequence
  synthetic oligonucleotide
gcaguccaugggcauauacac

SEQ ID NO: 3370 - RNA, 20 nt, Artificial Sequence
  synthetic oligonucleotide
gcaguccaugggcauauaca

SEQ ID NO: 3371 - RNA, 14 nt, Artificial Sequence
  synthetic oligonucleotide
ugcccauggacugc

SEQ ID NO: 3372 - RNA, 22 nt, Artificial Sequence
  synthetic oligonucleotide
uaugugccuuuggacuacaucg

SEQ ID NO: 3373 - RNA, 20 nt, Artificial Sequence
  synthetic oligonucleotide
uaugugccuuuggacuacau

SEQ ID NO: 3374 - RNA, 14 nt, Artificial Sequence
  synthetic oligonucleotide
uccaaaggcacaua

SEQ ID NO: 3375 - RNA, 23 nt, Artificial Sequence
  synthetic oligonucleotide
auacacauacacgcaacacacau

SEQ ID NO: 3376 - RNA, 20 nt, Artificial Sequence
  synthetic oligonucleotide
auacacauacacgcaacaca

SEQ ID NO: 3377 - RNA, 14 nt, Artificial Sequence
  synthetic oligonucleotide
gcguguauguguau

SEQ ID NO: 3378 - RNA, 21 nt, Artificial Sequence
  synthetic oligonucleotide
ucacuccucuccucccgucuu

SEQ ID NO: 3379 - RNA, 20 nt, Artificial Sequence
  synthetic oligonucleotide
ucacuccucuccucccgucu

SEQ ID NO: 3380 - RNA, 14 nt, Artificial Sequence
  synthetic oligonucleotide
gaggagaggaguga

SEQ ID NO: 3381 - RNA, 22 nt, Artificial Sequence
  synthetic oligonucleotide
aagacgggaggaaagaagggag

SEQ ID NO: 3382 - RNA, 20 nt, Artificial Sequence
  synthetic oligonucleotide
aagacgggaggaaagaaggg

SEQ ID NO: 3383 - RNA, 14 nt, Artificial Sequence
  synthetic oligonucleotide
uuuccucccgucuu

SEQ ID NO: 3384 - RNA, 22 nt, Artificial Sequence
  synthetic oligonucleotide
ucaggcucaguccccucccgau

SEQ ID NO: 3385 - RNA, 20 nt, Artificial Sequence
  synthetic oligonucleotide
ucaggcucaguccccucccg

SEQ ID NO: 3386 - RNA, 14 nt, Artificial Sequence
  synthetic oligonucleotide
gggacugagccuga

SEQ ID NO: 3387 - RNA, 22 nt, Artificial Sequence
  synthetic oligonucleotide
gucauacacggcucuccucucu

SEQ ID NO: 3388 - RNA, 20 nt, Artificial Sequence
  synthetic oligonucleotide
gucauacacggcucuccucu

SEQ ID NO: 3389 - RNA, 14 nt, Artificial Sequence
  synthetic oligonucleotide
gagccguguaugac

SEQ ID NO: 3390 - RNA, 22 nt, Artificial Sequence
  synthetic oligonucleotide
agaggcuggccgugaugaauuc

SEQ ID NO: 3391 - RNA, 20 nt, Artificial Sequence
  synthetic oligonucleotide
agaggcuggccgugaugaau

SEQ ID NO: 3392 - RNA, 14 nt, Artificial Sequence
  synthetic oligonucleotide
cacggccagccucu

SEQ ID NO: 3393 - RNA, 21 nt, Artificial Sequence
  synthetic oligonucleotide
cggggcagcucaguacaggau

SEQ ID NO: 3394 - RNA, 20 nt, Artificial Sequence
  synthetic oligonucleotide
cggggcagcucaguacagga

SEQ ID NO: 3395 - RNA, 14 nt, Artificial Sequence
  synthetic oligonucleotide
acugagcugccccg

SEQ ID NO: 3396 - RNA, 22 nt, Artificial Sequence
  synthetic oligonucleotide
uccuguacugagcugccccgag

SEQ ID NO: 3397 - RNA, 20 nt, Artificial Sequence
  synthetic oligonucleotide
uccuguacugagcugccccg

SEQ ID NO: 3398 - RNA, 14 nt, Artificial Sequence
  synthetic oligonucleotide
agcucaguacagga

SEQ ID NO: 3399 - RNA, 22 nt, Artificial Sequence
  synthetic oligonucleotide
aaucauacagggacauccaguu

SEQ ID NO: 3400 - RNA, 20 nt, Artificial Sequence
  synthetic oligonucleotide
aaucauacagggacauccag

SEQ ID NO: 3401 - RNA, 14 nt, Artificial Sequence
  synthetic oligonucleotide
gucccuguaugauu

SEQ ID NO: 3402 - RNA, 22 nt, Artificial Sequence
  synthetic oligonucleotide
aaucguacagggucauccacuu

SEQ ID NO: 3403 - RNA, 20 nt, Artificial Sequence
  synthetic oligonucleotide
aaucguacagggucauccac

SEQ ID NO: 3404 - RNA, 14 nt, Artificial Sequence
  synthetic oligonucleotide
gacccuguacgauu

SEQ ID NO: 3405 - RNA, 21 nt, Artificial Sequence
  synthetic oligonucleotide
uugaaaggcuauuucuugguc

SEQ ID NO: 3406 - RNA, 20 nt, Artificial Sequence
  synthetic oligonucleotide
uugaaaggcuauuucuuggu

SEQ ID NO: 3407 - RNA, 14 nt, Artificial Sequence
  synthetic oligonucleotide
aaauagccuuucaa

SEQ ID NO: 3408 - RNA, 21 nt, Artificial Sequence
  synthetic oligonucleotide
cccagauaauggcacucucaa

SEQ ID NO: 3409 - RNA, 20 nt, Artificial Sequence
  synthetic oligonucleotide
cccagauaauggcacucuca

SEQ ID NO: 3410 - RNA, 14 nt, Artificial Sequence
  synthetic oligonucleotide
ugccauuaucuggg

SEQ ID NO: 3411 - RNA, 22 nt, Artificial Sequence
  synthetic oligonucleotide
gugacaucacauauacggcagc

SEQ ID NO: 3412 - RNA, 20 nt, Artificial Sequence
  synthetic oligonucleotide
gugacaucacauauacggca

SEQ ID NO: 3413 - RNA, 14 nt, Artificial Sequence
  synthetic oligonucleotide
auaugugaugucac

SEQ ID NO: 3414 - RNA, 22 nt, Artificial Sequence
  synthetic oligonucleotide
caaccuggaggacuccaugcug

SEQ ID NO: 3415 - RNA, 20 nt, Artificial Sequence
  synthetic oligonucleotide
caaccuggaggacuccaugc

SEQ ID NO: 3416 - RNA, 14 nt, Artificial Sequence
  synthetic oligonucleotide
aguccuccagguug

SEQ ID NO: 3417 - RNA, 20 nt, Artificial Sequence
  synthetic oligonucleotide
ccauggaucuccaggugggu

SEQ ID NO: 3418 - RNA, 20 nt, Artificial Sequence
  synthetic oligonucleotide
ccauggaucuccaggugggu

SEQ ID NO: 3419 - RNA, 14 nt, Artificial Sequence
  synthetic oligonucleotide
cuggagauccaugg

SEQ ID NO: 3420 - RNA, 22 nt, Artificial Sequence
  synthetic oligonucleotide
cuuaugcaagauucccuucuac

SEQ ID NO: 3421 - RNA, 20 nt, Artificial Sequence
  synthetic oligonucleotide
cuuaugcaagauucccuucu

SEQ ID NO: 3422 - RNA, 14 nt, Artificial Sequence
  synthetic oligonucleotide
gaaucuugcauaag

SEQ ID NO: 3423 - RNA, 22 nt, Artificial Sequence
  synthetic oligonucleotide
aguggggaacccuuccaugagg

SEQ ID NO: 3424 - RNA, 20 nt, Artificial Sequence
  synthetic oligonucleotide
aguggggaacccuuccauga

SEQ ID NO: 3425 - RNA, 14 nt, Artificial Sequence
  synthetic oligonucleotide
aaggguuccccacu

SEQ ID NO: 3426 - RNA, 23 nt, Artificial Sequence
  synthetic oligonucleotide
aggaccugcgggacaagauucuu

SEQ ID NO: 3427 - RNA, 20 nt, Artificial Sequence
  synthetic oligonucleotide
aggaccugcgggacaagauu

SEQ ID NO: 3428 - RNA, 14 nt, Artificial Sequence
  synthetic oligonucleotide
gucccgcagguccu

SEQ ID NO: 3429 - RNA, 22 nt, Artificial Sequence
  synthetic oligonucleotide
ugaaggucuacugugugccagg

SEQ ID NO: 3430 - RNA, 20 nt, Artificial Sequence
  synthetic oligonucleotide
ugaaggucuacugugugcca

SEQ ID NO: 3431 - RNA, 14 nt, Artificial Sequence
  synthetic oligonucleotide
acaguagaccuuca

SEQ ID NO: 3432 - RNA, 22 nt, Artificial Sequence
  synthetic oligonucleotide
uuguacaugguaggcuuucauu

SEQ ID NO: 3433 - RNA, 20 nt, Artificial Sequence
  synthetic oligonucleotide
uuguacaugguaggcuuuca

SEQ ID NO: 3434 - RNA, 14 nt, Artificial Sequence
  synthetic oligonucleotide
ccuaccauguacaa

SEQ ID NO: 3435 - RNA, 22 nt, Artificial Sequence
  synthetic oligonucleotide
ugaaacauacacgggaaaccuc

SEQ ID NO: 3436 - RNA, 20 nt, Artificial Sequence
  synthetic oligonucleotide
ugaaacauacacgggaaacc

SEQ ID NO: 3437 - RNA, 14 nt, Artificial Sequence
  synthetic oligonucleotide
ccguguauguuuca

SEQ ID NO: 3438 - RNA, 22 nt, Artificial Sequence
  synthetic oligonucleotide
aaacaaacauggugcacuucuu

SEQ ID NO: 3439 - RNA, 20 nt, Artificial Sequence
  synthetic oligonucleotide
aaacaaacauggugcacuuc

SEQ ID NO: 3440 - RNA, 14 nt, Artificial Sequence
  synthetic oligonucleotide
caccauguuuguuu

SEQ ID NO: 3441 - RNA, 22 nt, Artificial Sequence
  synthetic oligonucleotide
ugaguauuacauggccaaucuc

SEQ ID NO: 3442 - RNA, 20 nt, Artificial Sequence
  synthetic oligonucleotide
ugaguauuacauggccaauc

SEQ ID NO: 3443 - RNA, 14 nt, Artificial Sequence
  synthetic oligonucleotide
ccauguaauacuca

SEQ ID NO: 3444 - RNA, 21 nt, Artificial Sequence
  synthetic oligonucleotide
cagcagcacacugugguuugu

SEQ ID NO: 3445 - RNA, 20 nt, Artificial Sequence
  synthetic oligonucleotide
cagcagcacacugugguuug

SEQ ID NO: 3446 - RNA, 14 nt, Artificial Sequence
  synthetic oligonucleotide
acagugugcugcug

SEQ ID NO: 3447 - RNA, 22 nt, Artificial Sequence
  synthetic oligonucleotide
caaaccacacugugguguuaga

SEQ ID NO: 3448 - RNA, 20 nt, Artificial Sequence
  synthetic oligonucleotide
caaaccacacugugguguua

SEQ ID NO: 3449 - RNA, 14 nt, Artificial Sequence
  synthetic oligonucleotide
cacagugugguuug

SEQ ID NO: 3450 - RNA, 23 nt, Artificial Sequence
  synthetic oligonucleotide
uuucaagccagggggcguuuuuc

SEQ ID NO: 3451 - RNA, 20 nt, Artificial Sequence
  synthetic oligonucleotide
uuucaagccagggggcguuu

SEQ ID NO: 3452 - RNA, 14 nt, Artificial Sequence
  synthetic oligonucleotide
ccccuggcuugaaa

SEQ ID NO: 3453 - RNA, 22 nt, Artificial Sequence
  synthetic oligonucleotide
aacaucacagcaagucugugcu

SEQ ID NO: 3454 - RNA, 20 nt, Artificial Sequence
  synthetic oligonucleotide
aacaucacagcaagucugug

SEQ ID NO: 3455 - RNA, 14 nt, Artificial Sequence
  synthetic oligonucleotide
cuugcugugauguu

SEQ ID NO: 3456 - RNA, 21 nt, Artificial Sequence
  synthetic oligonucleotide
uuaagacuugcagugauguuu

SEQ ID NO: 3457 - RNA, 20 nt, Artificial Sequence
  synthetic oligonucleotide
uuaagacuugcagugauguu

SEQ ID NO: 3458 - RNA, 14 nt, Artificial Sequence
  synthetic oligonucleotide
acugcaagucuuaa

SEQ ID NO: 3459 - RNA, 23 nt, Artificial Sequence
  synthetic oligonucleotide
uaauccuugcuaccugggugaga

SEQ ID NO: 3460 - RNA, 20 nt, Artificial Sequence
  synthetic oligonucleotide
uaauccuugcuaccugggug

SEQ ID NO: 3461 - RNA, 14 nt, Artificial Sequence
  synthetic oligonucleotide
gguagcaaggauua

SEQ ID NO: 3462 - RNA, 22 nt, Artificial Sequence
  synthetic oligonucleotide
augcaccugggcaaggauucug

SEQ ID NO: 3463 - RNA, 20 nt, Artificial Sequence
  synthetic oligonucleotide
augcaccugggcaaggauuc

SEQ ID NO: 3464 - RNA, 14 nt, Artificial Sequence
  synthetic oligonucleotide
uugcccaggugcau

SEQ ID NO: 3465 - RNA, 18 nt, Artificial Sequence
  synthetic oligonucleotide
aauccuugcuaccugggu

SEQ ID NO: 3466 - RNA, 18 nt, Artificial Sequence
  synthetic oligonucleotide
aauccuugcuaccugggu

SEQ ID NO: 3467 - RNA, 14 nt, Artificial Sequence
  synthetic oligonucleotide
agguagcaaggauu

SEQ ID NO: 3468 - RNA, 22 nt, Artificial Sequence
  synthetic oligonucleotide
aaugcacccgggcaaggauucu

SEQ ID NO: 3469 - RNA, 20 nt, Artificial Sequence
  synthetic oligonucleotide
aaugcacccgggcaaggauu

SEQ ID NO: 3470 - RNA, 14 nt, Artificial Sequence
  synthetic oligonucleotide
ugcccgggugcauu

SEQ ID NO: 3471 - RNA, 22 nt, Artificial Sequence
  synthetic oligonucleotide
aauccuuugucccugggugaga

SEQ ID NO: 3472 - RNA, 20 nt, Artificial Sequence
  synthetic oligonucleotide
aauccuuugucccuggguga

SEQ ID NO: 3473 - RNA, 14 nt, Artificial Sequence
  synthetic oligonucleotide
agggacaaaggauu

SEQ ID NO: 3474 - RNA, 22 nt, Artificial Sequence
  synthetic oligonucleotide
aaugcaccugggcaaggauuca

SEQ ID NO: 3475 - RNA, 20 nt, Artificial Sequence
  synthetic oligonucleotide
aaugcaccugggcaaggauu

SEQ ID NO: 3476 - RNA, 14 nt, Artificial Sequence
  synthetic oligonucleotide
ugcccaggugcauu

SEQ ID NO: 3477 - RNA, 21 nt, Artificial Sequence
  synthetic oligonucleotide
auccuugcuaucugggugcua

SEQ ID NO: 3478 - RNA, 20 nt, Artificial Sequence
  synthetic oligonucleotide
auccuugcuaucugggugcu

SEQ ID NO: 3479 - RNA, 14 nt, Artificial Sequence
  synthetic oligonucleotide
cagauagcaaggau

SEQ ID NO: 3480 - RNA, 23 nt, Artificial Sequence
  synthetic oligonucleotide
uagcagcgggaacaguucugcag

SEQ ID NO: 3481 - RNA, 20 nt, Artificial Sequence
  synthetic oligonucleotide
uagcagcgggaacaguucug

SEQ ID NO: 3482 - RNA, 14 nt, Artificial Sequence
  synthetic oligonucleotide
uguucccgcugcua

SEQ ID NO: 3483 - RNA, 22 nt, Artificial Sequence
  synthetic oligonucleotide
agacccuggucugcacucuauc

SEQ ID NO: 3484 - RNA, 20 nt, Artificial Sequence
  synthetic oligonucleotide
agacccuggucugcacucua

SEQ ID NO: 3485 - RNA, 14 nt, Artificial Sequence
  synthetic oligonucleotide
gcagaccagggucu

SEQ ID NO: 3486 - RNA, 22 nt, Artificial Sequence
  synthetic oligonucleotide
cgucaacacuugcugguuuccu

SEQ ID NO: 3487 - RNA, 20 nt, Artificial Sequence
  synthetic oligonucleotide
cgucaacacuugcugguuuc

SEQ ID NO: 3488 - RNA, 14 nt, Artificial Sequence
  synthetic oligonucleotide
agcaaguguugacg

SEQ ID NO: 3489 - RNA, 22 nt, Artificial Sequence
  synthetic oligonucleotide
gggagccaggaaguauugaugu

SEQ ID NO: 3490 - RNA, 20 nt, Artificial Sequence
  synthetic oligonucleotide
gggagccaggaaguauugau

SEQ ID NO: 3491 - RNA, 14 nt, Artificial Sequence
  synthetic oligonucleotide
acuuccuggcuccc

SEQ ID NO: 3492 - RNA, 21 nt, Artificial Sequence
  synthetic oligonucleotide
uaaggcacccuucugaguaga

SEQ ID NO: 3493 - RNA, 20 nt, Artificial Sequence
  synthetic oligonucleotide
uaaggcacccuucugaguag

SEQ ID NO: 3494 - RNA, 14 nt, Artificial Sequence
  synthetic oligonucleotide
agaagggugccuua

SEQ ID NO: 3495 - RNA, 21 nt, Artificial Sequence
  synthetic oligonucleotide
uuuugcaccuuuuggagugaa

SEQ ID NO: 3496 - RNA, 20 nt, Artificial Sequence
  synthetic oligonucleotide
uuuugcaccuuuuggaguga

SEQ ID NO: 3497 - RNA, 14 nt, Artificial Sequence
  synthetic oligonucleotide
caaaaggugcaaaa

SEQ ID NO: 3498 - RNA, 23 nt, Artificial Sequence
  synthetic oligonucleotide
ugauuguagccuuuuggaguaga

SEQ ID NO: 3499 - RNA, 20 nt, Artificial Sequence
  synthetic oligonucleotide
ugauuguagccuuuuggagu

SEQ ID NO: 3500 - RNA, 14 nt, Artificial Sequence
  synthetic oligonucleotide
aaaggcuacaauca

SEQ ID NO: 3501 - RNA, 23 nt, Artificial Sequence
  synthetic oligonucleotide
uacuccagagggcgucacucaug

SEQ ID NO: 3502 - RNA, 20 nt, Artificial Sequence
  synthetic oligonucleotide
uacuccagagggcgucacuc

SEQ ID NO: 3503 - RNA, 14 nt, Artificial Sequence
  synthetic oligonucleotide
cgcccucuggagua

SEQ ID NO: 3504 - RNA, 22 nt, Artificial Sequence
  synthetic oligonucleotide
uacugcagacguggcaaucaug

SEQ ID NO: 3505 - RNA, 20 nt, Artificial Sequence
  synthetic oligonucleotide
uacugcagacguggcaauca

SEQ ID NO: 3506 - RNA, 14 nt, Artificial Sequence
  synthetic oligonucleotide
ccacgucugcagua

SEQ ID NO: 3507 - RNA, 22 nt, Artificial Sequence
  synthetic oligonucleotide
ugauugguacgucuguggguag

SEQ ID NO: 3508 - RNA, 20 nt, Artificial Sequence
  synthetic oligonucleotide
ugauugguacgucugugggu

SEQ ID NO: 3509 - RNA, 14 nt, Artificial Sequence
  synthetic oligonucleotide
agacguaccaauca

SEQ ID NO: 3510 - RNA, 21 nt, Artificial Sequence
  synthetic oligonucleotide
uacugcagacaguggcaauca

SEQ ID NO: 3511 - RNA, 20 nt, Artificial Sequence
  synthetic oligonucleotide
uacugcagacaguggcaauc

SEQ ID NO: 3512 - RNA, 14 nt, Artificial Sequence
  synthetic oligonucleotide
cacugucugcagua

SEQ ID NO: 3513 - RNA, 22 nt, Artificial Sequence
  synthetic oligonucleotide
uacucaggagaguggcaaucac

SEQ ID NO: 3514 - RNA, 20 nt, Artificial Sequence
  synthetic oligonucleotide
uacucaggagaguggcaauc

SEQ ID NO: 3515 - RNA, 14 nt, Artificial Sequence
  synthetic oligonucleotide
cacucuccugagua

SEQ ID NO: 3516 - RNA, 21 nt, Artificial Sequence
  synthetic oligonucleotide
gugucuuuugcucugcaguca

SEQ ID NO: 3517 - RNA, 20 nt, Artificial Sequence
  synthetic oligonucleotide
gugucuuuugcucugcaguc

SEQ ID NO: 3518 - RNA, 14 nt, Artificial Sequence
  synthetic oligonucleotide
agagcaaaagacac

SEQ ID NO: 3519 - RNA, 22 nt, Artificial Sequence
  synthetic oligonucleotide
aagugcugucauagcugagguc

SEQ ID NO: 3520 - RNA, 20 nt, Artificial Sequence
  synthetic oligonucleotide
aagugcugucauagcugagg

SEQ ID NO: 3521 - RNA, 14 nt, Artificial Sequence
  synthetic oligonucleotide
cuaugacagcacuu

SEQ ID NO: 3522 - RNA, 23 nt, Artificial Sequence
  synthetic oligonucleotide
cacucagccuugagggcacuuuc

SEQ ID NO: 3523 - RNA, 20 nt, Artificial Sequence
  synthetic oligonucleotide
cacucagccuugagggcacu

SEQ ID NO: 3524 - RNA, 14 nt, Artificial Sequence
  synthetic oligonucleotide
cucaaggcugagug

SEQ ID NO: 3525 - RNA, 23 nt, Artificial Sequence
  synthetic oligonucleotide
uaaauuucaccuuucugagaagg

SEQ ID NO: 3526 - RNA, 20 nt, Artificial Sequence
  synthetic oligonucleotide
uaaauuucaccuuucugaga

SEQ ID NO: 3527 - RNA, 14 nt, Artificial Sequence
  synthetic oligonucleotide
aaaggugaaauuua

SEQ ID NO: 3528 - RNA, 18 nt, Artificial Sequence
  synthetic oligonucleotide
uucacagggaggugucau

SEQ ID NO: 3529 - RNA, 18 nt, Artificial Sequence
  synthetic oligonucleotide
uucacagggaggugucau

SEQ ID NO: 3530 - RNA, 14 nt, Artificial Sequence
  synthetic oligonucleotide
caccucccugugaa

SEQ ID NO: 3531 - RNA, 22 nt, Artificial Sequence
  synthetic oligonucleotide
uucacaaggaggugucauuuau

SEQ ID NO: 3532 - RNA, 20 nt, Artificial Sequence
  synthetic oligonucleotide
uucacaaggaggugucauuu

SEQ ID NO: 3533 - RNA, 14 nt, Artificial Sequence
  synthetic oligonucleotide
caccuccuugugaa

SEQ ID NO: 3534 - RNA, 22 nt, Artificial Sequence
  synthetic oligonucleotide
uucucaaggaggugucguuuau

SEQ ID NO: 3535 - RNA, 20 nt, Artificial Sequence
  synthetic oligonucleotide
uucucaaggaggugucguuu

SEQ ID NO: 3536 - RNA, 14 nt, Artificial Sequence
  synthetic oligonucleotide
caccuccuugagaa

SEQ ID NO: 3537 - RNA, 21 nt, Artificial Sequence
  synthetic oligonucleotide
auugacacuucugugaguaga

SEQ ID NO: 3538 - RNA, 20 nt, Artificial Sequence
  synthetic oligonucleotide
auugacacuucugugaguag

SEQ ID NO: 3539 - RNA, 14 nt, Artificial Sequence
  synthetic oligonucleotide
acagaagugucaau

SEQ ID NO: 3540 - RNA, 21 nt, Artificial Sequence
  synthetic oligonucleotide
auugacaccucugugagugga

SEQ ID NO: 3541 - RNA, 20 nt, Artificial Sequence
  synthetic oligonucleotide
auugacaccucugugagugg

SEQ ID NO: 3542 - RNA, 14 nt, Artificial Sequence
  synthetic oligonucleotide
acagaggugucaau

SEQ ID NO: 3543 - RNA, 22 nt, Artificial Sequence
  synthetic oligonucleotide
uucucaagagggaggcaaucau

SEQ ID NO: 3544 - RNA, 20 nt, Artificial Sequence
  synthetic oligonucleotide
uucucaagagggaggcaauc

SEQ ID NO: 3545 - RNA, 14 nt, Artificial Sequence
  synthetic oligonucleotide
cucccucuugagaa

SEQ ID NO: 3546 - RNA, 22 nt, Artificial Sequence
  synthetic oligonucleotide
gagugccuucuuuuggagcguu

SEQ ID NO: 3547 - RNA, 20 nt, Artificial Sequence
  synthetic oligonucleotide
gagugccuucuuuuggagcg

SEQ ID NO: 3548 - RNA, 14 nt, Artificial Sequence
  synthetic oligonucleotide
aaaagaaggcacuc

SEQ ID NO: 3549 - RNA, 24 nt, Artificial Sequence
  synthetic oligonucleotide
uucuccaaaagaaagcacuuucug

SEQ ID NO: 3550 - RNA, 20 nt, Artificial Sequence
  synthetic oligonucleotide
uucuccaaaagaaagcacuu

SEQ ID NO: 3551 - RNA, 14 nt, Artificial Sequence
  synthetic oligonucleotide
uuucuuuuggagaa

SEQ ID NO: 3552 - RNA, 18 nt, Artificial Sequence
  synthetic oligonucleotide
ugcuuccuuucagagggu

SEQ ID NO: 3553 - RNA, 18 nt, Artificial Sequence
  synthetic oligonucleotide
ugcuuccuuucagagggu

SEQ ID NO: 3554 - RNA, 14 nt, Artificial Sequence
  synthetic oligonucleotide
ucugaaaggaagca

SEQ ID NO: 3555 - RNA, 23 nt, Artificial Sequence
  synthetic oligonucleotide
uucucgaggaaagaagcacuuuc

SEQ ID NO: 3556 - RNA, 20 nt, Artificial Sequence
  synthetic oligonucleotide
uucucgaggaaagaagcacu

SEQ ID NO: 3557 - RNA, 14 nt, Artificial Sequence
  synthetic oligonucleotide
ucuuuccucgagaa

SEQ ID NO: 3558 - RNA, 22 nt, Artificial Sequence
  synthetic oligonucleotide
aucuggagguaagaagcacuuu

SEQ ID NO: 3559 - RNA, 20 nt, Artificial Sequence
  synthetic oligonucleotide
aucuggagguaagaagcacu

SEQ ID NO: 3560 - RNA, 14 nt, Artificial Sequence
  synthetic oligonucleotide
ucuuaccuccagau

SEQ ID NO: 3561 - RNA, 18 nt, Artificial Sequence
  synthetic oligonucleotide
ugcuuccuuucagagggu

SEQ ID NO: 3562 - RNA, 18 nt, Artificial Sequence
  synthetic oligonucleotide
ugcuuccuuucagagggu

SEQ ID NO: 3563 - RNA, 14 nt, Artificial Sequence
  synthetic oligonucleotide
ucugaaaggaagca

SEQ ID NO: 3564 - RNA, 22 nt, Artificial Sequence
  synthetic oligonucleotide
ccucuagauggaagcacugucu

SEQ ID NO: 3565 - RNA, 20 nt, Artificial Sequence
  synthetic oligonucleotide
ccucuagauggaagcacugu

SEQ ID NO: 3566 - RNA, 14 nt, Artificial Sequence
  synthetic oligonucleotide
cuuccaucuagagg

SEQ ID NO: 3567 - RNA, 22 nt, Artificial Sequence
  synthetic oligonucleotide
aucgugcaucccuuuagagugu

SEQ ID NO: 3568 - RNA, 20 nt, Artificial Sequence
  synthetic oligonucleotide
aucgugcaucccuuuagagu

SEQ ID NO: 3569 - RNA, 14 nt, Artificial Sequence
  synthetic oligonucleotide
aagggaugcacgau

SEQ ID NO: 3570 - RNA, 22 nt, Artificial Sequence
  synthetic oligonucleotide
ucgugcaucccuuuagaguguu

SEQ ID NO: 3571 - RNA, 20 nt, Artificial Sequence
  synthetic oligonucleotide
ucgugcaucccuuuagagug

SEQ ID NO: 3572 - RNA, 14 nt, Artificial Sequence
  synthetic oligonucleotide
aaagggaugcacga

SEQ ID NO: 3573 - RNA, 22 nt, Artificial Sequence
  synthetic oligonucleotide
aucgugcauccuuuuagagugu

SEQ ID NO: 3574 - RNA, 20 nt, Artificial Sequence
  synthetic oligonucleotide
aucgugcauccuuuuagagu

SEQ ID NO: 3575 - RNA, 14 nt, Artificial Sequence
  synthetic oligonucleotide
aaaggaugcacgau

SEQ ID NO: 3576 - RNA, 22 nt, Artificial Sequence
  synthetic oligonucleotide
gaaagcgcuucccuuugcugga

SEQ ID NO: 3577 - RNA, 20 nt, Artificial Sequence
  synthetic oligonucleotide
gaaagcgcuucccuuugcug

SEQ ID NO: 3578 - RNA, 14 nt, Artificial Sequence
  synthetic oligonucleotide
agggaagcgcuuuc

SEQ ID NO: 3579 - RNA, 20 nt, Artificial Sequence
  synthetic oligonucleotide
cugcaaagggaagcccuuuc

SEQ ID NO: 3580 - RNA, 20 nt, Artificial Sequence
  synthetic oligonucleotide
cugcaaagggaagcccuuuc

SEQ ID NO: 3581 - RNA, 14 nt, Artificial Sequence
  synthetic oligonucleotide
gcuucccuuugcag

SEQ ID NO: 3582 - RNA, 22 nt, Artificial Sequence
  synthetic oligonucleotide
caaagcgcuccccuuuagaggu

SEQ ID NO: 3583 - RNA, 20 nt, Artificial Sequence
  synthetic oligonucleotide
caaagcgcuccccuuuagag

SEQ ID NO: 3584 - RNA, 14 nt, Artificial Sequence
  synthetic oligonucleotide
aggggagcgcuuug

SEQ ID NO: 3585 - RNA, 23 nt, Artificial Sequence
  synthetic oligonucleotide
caaagcgcuucucuuuagagugu

SEQ ID NO: 3586 - RNA, 20 nt, Artificial Sequence
  synthetic oligonucleotide
caaagcgcuucucuuuagag

SEQ ID NO: 3587 - RNA, 14 nt, Artificial Sequence
  synthetic oligonucleotide
agagaagcgcuuug

SEQ ID NO: 3588 - RNA, 23 nt, Artificial Sequence
  synthetic oligonucleotide
ucucuggagggaagcacuuucug

SEQ ID NO: 3589 - RNA, 20 nt, Artificial Sequence
  synthetic oligonucleotide
ucucuggagggaagcacuuu

SEQ ID NO: 3590 - RNA, 14 nt, Artificial Sequence
  synthetic oligonucleotide
cuucccuccagaga

SEQ ID NO: 3591 - RNA, 21 nt, Artificial Sequence
  synthetic oligonucleotide
caaagcgcuucccuuuggagc

SEQ ID NO: 3592 - RNA, 20 nt, Artificial Sequence
  synthetic oligonucleotide
caaagcgcuucccuuuggag

SEQ ID NO: 3593 - RNA, 14 nt, Artificial Sequence
  synthetic oligonucleotide
agggaagcgcuuug

SEQ ID NO: 3594 - RNA, 22 nt, Artificial Sequence
  synthetic oligonucleotide
cucuagagggaagcacuuucug

SEQ ID NO: 3595 - RNA, 20 nt, Artificial Sequence
  synthetic oligonucleotide
cucuagagggaagcacuuuc

SEQ ID NO: 3596 - RNA, 14 nt, Artificial Sequence
  synthetic oligonucleotide
gcuucccucuagag

SEQ ID NO: 3597 - RNA, 21 nt, Artificial Sequence
  synthetic oligonucleotide
aaagcgcuucccuucagagug

SEQ ID NO: 3598 - RNA, 20 nt, Artificial Sequence
  synthetic oligonucleotide
aaagcgcuucccuucagagu

SEQ ID NO: 3599 - RNA, 14 nt, Artificial Sequence
  synthetic oligonucleotide
aagggaagcgcuuu

SEQ ID NO: 3600 - RNA, 22 nt, Artificial Sequence
  synthetic oligonucleotide
cucuagagggaagcgcuuucug

SEQ ID NO: 3601 - RNA, 20 nt, Artificial Sequence
  synthetic oligonucleotide
cucuagagggaagcgcuuuc

SEQ ID NO: 3602 - RNA, 14 nt, Artificial Sequence
  synthetic oligonucleotide
gcuucccucuagag

SEQ ID NO: 3603 - RNA, 21 nt, Artificial Sequence
  synthetic oligonucleotide
gaaagcgcuucucuuuagagg

SEQ ID NO: 3604 - RNA, 20 nt, Artificial Sequence
  synthetic oligonucleotide
gaaagcgcuucucuuuagag

SEQ ID NO: 3605 - RNA, 14 nt, Artificial Sequence
  synthetic oligonucleotide
agagaagcgcuuuc

SEQ ID NO: 3606 - RNA, 22 nt, Artificial Sequence
  synthetic oligonucleotide
cucuagagggaagcacuuucuc

SEQ ID NO: 3607 - RNA, 20 nt, Artificial Sequence
  synthetic oligonucleotide
cucuagagggaagcacuuuc

SEQ ID NO: 3608 - RNA, 14 nt, Artificial Sequence
  synthetic oligonucleotide
gcuucccucuagag

SEQ ID NO: 3609 - RNA, 22 nt, Artificial Sequence
  synthetic oligonucleotide
aaagugcauccuuuuagagugu

SEQ ID NO: 3610 - RNA, 20 nt, Artificial Sequence
  synthetic oligonucleotide
aaagugcauccuuuuagagu

SEQ ID NO: 3611 - RNA, 14 nt, Artificial Sequence
  synthetic oligonucleotide
aaaggaugcacuuu

SEQ ID NO: 3612 - RNA, 22 nt, Artificial Sequence
  synthetic oligonucleotide
cucuagagggaagcgcuuucug

SEQ ID NO: 3613 - RNA, 20 nt, Artificial Sequence
  synthetic oligonucleotide
cucuagagggaagcgcuuuc

SEQ ID NO: 3614 - RNA, 14 nt, Artificial Sequence
  synthetic oligonucleotide
gcuucccucuagag

SEQ ID NO: 3615 - RNA, 22 nt, Artificial Sequence
  synthetic oligonucleotide
aaagugcauccuuuuagagguu

SEQ ID NO: 3616 - RNA, 20 nt, Artificial Sequence
  synthetic oligonucleotide
aaagugcauccuuuuagagg

SEQ ID NO: 3617 - RNA, 14 nt, Artificial Sequence
  synthetic oligonucleotide
aaaggaugcacuuu

SEQ ID NO: 3618 - RNA, 22 nt, Artificial Sequence
  synthetic oligonucleotide
cucuagagggaagcgcuuucug

SEQ ID NO: 3619 - RNA, 20 nt, Artificial Sequence
  synthetic oligonucleotide
cucuagagggaagcgcuuuc

SEQ ID NO: 3620 - RNA, 14 nt, Artificial Sequence
  synthetic oligonucleotide
gcuucccucuagag

SEQ ID NO: 3621 - RNA, 22 nt, Artificial Sequence
  synthetic oligonucleotide
aaagugcaucuuuuuagaggau

SEQ ID NO: 3622 - RNA, 20 nt, Artificial Sequence
  synthetic oligonucleotide
aaagugcaucuuuuuagagg

SEQ ID NO: 3623 - RNA, 14 nt, Artificial Sequence
  synthetic oligonucleotide
aaaagaugcacuuu

SEQ ID NO: 3624 - RNA, 22 nt, Artificial Sequence
  synthetic oligonucleotide
cucuagagggaagcgcuuucug

SEQ ID NO: 3625 - RNA, 20 nt, Artificial Sequence
  synthetic oligonucleotide
cucuagagggaagcgcuuuc

SEQ ID NO: 3626 - RNA, 14 nt, Artificial Sequence
  synthetic oligonucleotide
gcuucccucuagag

SEQ ID NO: 3627 - RNA, 22 nt, Artificial Sequence
  synthetic oligonucleotide
caaagugccucccuuuagagug

SEQ ID NO: 3628 - RNA, 20 nt, Artificial Sequence
  synthetic oligonucleotide
caaagugccucccuuuagag

SEQ ID NO: 3629 - RNA, 14 nt, Artificial Sequence
  synthetic oligonucleotide
agggaggcacuuug

SEQ ID NO: 3630 - RNA, 22 nt, Artificial Sequence
  synthetic oligonucleotide
aagugccuccuuuuagaguguu

SEQ ID NO: 3631 - RNA, 20 nt, Artificial Sequence
  synthetic oligonucleotide
aagugccuccuuuuagagug

SEQ ID NO: 3632 - RNA, 14 nt, Artificial Sequence
  synthetic oligonucleotide
aaaaggaggcacuu

SEQ ID NO: 3633 - RNA, 22 nt, Artificial Sequence
  synthetic oligonucleotide
uucuccaaaagggagcacuuuc

SEQ ID NO: 3634 - RNA, 20 nt, Artificial Sequence
  synthetic oligonucleotide
uucuccaaaagggagcacuu

SEQ ID NO: 3635 - RNA, 14 nt, Artificial Sequence
  synthetic oligonucleotide
ucccuuuuggagaa

SEQ ID NO: 3636 - RNA, 22 nt, Artificial Sequence
  synthetic oligonucleotide
aaagugcuucccuuuggacugu

SEQ ID NO: 3637 - RNA, 20 nt, Artificial Sequence
  synthetic oligonucleotide
aaagugcuucccuuuggacu

SEQ ID NO: 3638 - RNA, 14 nt, Artificial Sequence
  synthetic oligonucleotide
aagggaagcacuuu

SEQ ID NO: 3639 - RNA, 21 nt, Artificial Sequence
  synthetic oligonucleotide
cuccagagggaaguacuuucu

SEQ ID NO: 3640 - RNA, 20 nt, Artificial Sequence
  synthetic oligonucleotide
cuccagagggaaguacuuuc

SEQ ID NO: 3641 - RNA, 14 nt, Artificial Sequence
  synthetic oligonucleotide
acuucccucuggag

SEQ ID NO: 3642 - RNA, 21 nt, Artificial Sequence
  synthetic oligonucleotide
aaagugcuuccuuuuagaggg

SEQ ID NO: 3643 - RNA, 20 nt, Artificial Sequence
  synthetic oligonucleotide
aaagugcuuccuuuuagagg

SEQ ID NO: 3644 - RNA, 14 nt, Artificial Sequence
  synthetic oligonucleotide
aaaggaagcacuuu

SEQ ID NO: 3645 - RNA, 22 nt, Artificial Sequence
  synthetic oligonucleotide
aaagugcuuccuuuuagagggu

SEQ ID NO: 3646 - RNA, 20 nt, Artificial Sequence
  synthetic oligonucleotide
aaagugcuuccuuuuagagg

SEQ ID NO: 3647 - RNA, 14 nt, Artificial Sequence
  synthetic oligonucleotide
aaaggaagcacuuu

SEQ ID NO: 3648 - RNA, 22 nt, Artificial Sequence
  synthetic oligonucleotide
cucuagagggaagcacuuucug

SEQ ID NO: 3649 - RNA, 20 nt, Artificial Sequence
  synthetic oligonucleotide
cucuagagggaagcacuuuc

SEQ ID NO: 3650 - RNA, 14 nt, Artificial Sequence
  synthetic oligonucleotide
gcuucccucuagag

SEQ ID NO: 3651 - RNA, 22 nt, Artificial Sequence
  synthetic oligonucleotide
aaagugcuucucuuuggugggu

SEQ ID NO: 3652 - RNA, 20 nt, Artificial Sequence
  synthetic oligonucleotide
aaagugcuucucuuuggugg

SEQ ID NO: 3653 - RNA, 14 nt, Artificial Sequence
  synthetic oligonucleotide
aagagaagcacuuu

SEQ ID NO: 3654 - RNA, 20 nt, Artificial Sequence
  synthetic oligonucleotide
cuacaaagggaagcccuuuc

SEQ ID NO: 3655 - RNA, 20 nt, Artificial Sequence
  synthetic oligonucleotide
cuacaaagggaagcccuuuc

SEQ ID NO: 3656 - RNA, 14 nt, Artificial Sequence
  synthetic oligonucleotide
gcuucccuuuguag

SEQ ID NO: 3657 - RNA, 21 nt, Artificial Sequence
  synthetic oligonucleotide
aaagugcuuccuuuuugaggg

SEQ ID NO: 3658 - RNA, 20 nt, Artificial Sequence
  synthetic oligonucleotide
aaagugcuuccuuuuugagg

SEQ ID NO: 3659 - RNA, 14 nt, Artificial Sequence
  synthetic oligonucleotide
aaaggaagcacuuu

SEQ ID NO: 3660 - RNA, 22 nt, Artificial Sequence
  synthetic oligonucleotide
aagugcuuccuuuuagaggguu

SEQ ID NO: 3661 - RNA, 20 nt, Artificial Sequence
  synthetic oligonucleotide
aagugcuuccuuuuagaggg

SEQ ID NO: 3662 - RNA, 14 nt, Artificial Sequence
  synthetic oligonucleotide
aaaaggaagcacuu

SEQ ID NO: 3663 - RNA, 24 nt, Artificial Sequence
  synthetic oligonucleotide
acaaagugcuucccuuuagagugu

SEQ ID NO: 3664 - RNA, 20 nt, Artificial Sequence
  synthetic oligonucleotide
acaaagugcuucccuuuaga

SEQ ID NO: 3665 - RNA, 14 nt, Artificial Sequence
  synthetic oligonucleotide
gggaagcacuuugu

SEQ ID NO: 3666 - RNA, 22 nt, Artificial Sequence
  synthetic oligonucleotide
acaaagugcuucccuuuagagu

SEQ ID NO: 3667 - RNA, 20 nt, Artificial Sequence
  synthetic oligonucleotide
acaaagugcuucccuuuaga

SEQ ID NO: 3668 - RNA, 14 nt, Artificial Sequence
  synthetic oligonucleotide
gggaagcacuuugu

SEQ ID NO: 3669 - RNA, 22 nt, Artificial Sequence
  synthetic oligonucleotide
aacgcacuucccuuuagagugu

SEQ ID NO: 3670 - RNA, 20 nt, Artificial Sequence
  synthetic oligonucleotide
aacgcacuucccuuuagagu

SEQ ID NO: 3671 - RNA, 14 nt, Artificial Sequence
  synthetic oligonucleotide
aagggaagugcguu

SEQ ID NO: 3672 - RNA, 22 nt, Artificial Sequence
  synthetic oligonucleotide
aaaaugguucccuuuagagugu

SEQ ID NO: 3673 - RNA, 20 nt, Artificial Sequence
  synthetic oligonucleotide
aaaaugguucccuuuagagu

SEQ ID NO: 3674 - RNA, 14 nt, Artificial Sequence
  synthetic oligonucleotide
aagggaaccauuuu

SEQ ID NO: 3675 - RNA, 22 nt, Artificial Sequence
  synthetic oligonucleotide
cucuagagggaagcgcuuucug

SEQ ID NO: 3676 - RNA, 20 nt, Artificial Sequence
  synthetic oligonucleotide
cucuagagggaagcgcuuuc

SEQ ID NO: 3677 - RNA, 14 nt, Artificial Sequence
  synthetic oligonucleotide
gcuucccucuagag

SEQ ID NO: 3678 - RNA, 23 nt, Artificial Sequence
  synthetic oligonucleotide
gaacgcgcuucccuauagagggu

SEQ ID NO: 3679 - RNA, 20 nt, Artificial Sequence
  synthetic oligonucleotide
gaacgcgcuucccuauagag

SEQ ID NO: 3680 - RNA, 14 nt, Artificial Sequence
  synthetic oligonucleotide
agggaagcgcguuc

SEQ ID NO: 3681 - RNA, 22 nt, Artificial Sequence
  synthetic oligonucleotide
cucuagagggaagcgcuuucug

SEQ ID NO: 3682 - RNA, 20 nt, Artificial Sequence
  synthetic oligonucleotide
cucuagagggaagcgcuuuc

SEQ ID NO: 3683 - RNA, 14 nt, Artificial Sequence
  synthetic oligonucleotide
gcuucccucuagag

SEQ ID NO: 3684 - RNA, 21 nt, Artificial Sequence
  synthetic oligonucleotide
gaaggcgcuucccuuuggagu

SEQ ID NO: 3685 - RNA, 20 nt, Artificial Sequence
  synthetic oligonucleotide
gaaggcgcuucccuuuggag

SEQ ID NO: 3686 - RNA, 14 nt, Artificial Sequence
  synthetic oligonucleotide
agggaagcgccuuc

SEQ ID NO: 3687 - RNA, 22 nt, Artificial Sequence
  synthetic oligonucleotide
cuacaaagggaagcacuuucuc

SEQ ID NO: 3688 - RNA, 20 nt, Artificial Sequence
  synthetic oligonucleotide
cuacaaagggaagcacuuuc

SEQ ID NO: 3689 - RNA, 14 nt, Artificial Sequence
  synthetic oligonucleotide
gcuucccuuuguag

SEQ ID NO: 3690 - RNA, 22 nt, Artificial Sequence
  synthetic oligonucleotide
gaaggcgcuucccuuuagagcg

SEQ ID NO: 3691 - RNA, 20 nt, Artificial Sequence
  synthetic oligonucleotide
gaaggcgcuucccuuuagag

SEQ ID NO: 3692 - RNA, 14 nt, Artificial Sequence
  synthetic oligonucleotide
agggaagcgccuuc

SEQ ID NO: 3693 - RNA, 21 nt, Artificial Sequence
  synthetic oligonucleotide
cuccagagggaugcacuuucu

SEQ ID NO: 3694 - RNA, 20 nt, Artificial Sequence
  synthetic oligonucleotide
cuccagagggaugcacuuuc

SEQ ID NO: 3695 - RNA, 14 nt, Artificial Sequence
  synthetic oligonucleotide
gcaucccucuggag

SEQ ID NO: 3696 - RNA, 22 nt, Artificial Sequence
  synthetic oligonucleotide
cucuagagggaagcacuuucug

SEQ ID NO: 3697 - RNA, 20 nt, Artificial Sequence
  synthetic oligonucleotide
cucuagagggaagcacuuuc

SEQ ID NO: 3698 - RNA, 14 nt, Artificial Sequence
  synthetic oligonucleotide
gcuucccucuagag

SEQ ID NO: 3699 - RNA, 23 nt, Artificial Sequence
  synthetic oligonucleotide
cucuugagggaagcacuuucugu

SEQ ID NO: 3700 - RNA, 20 nt, Artificial Sequence
  synthetic oligonucleotide
cucuugagggaagcacuuuc

SEQ ID NO: 3701 - RNA, 14 nt, Artificial Sequence
  synthetic oligonucleotide
gcuucccucaagag

SEQ ID NO: 3702 - RNA, 22 nt, Artificial Sequence
  synthetic oligonucleotide
gaaagugcuuccuuuuagaggc

SEQ ID NO: 3703 - RNA, 20 nt, Artificial Sequence
  synthetic oligonucleotide
gaaagugcuuccuuuuagag

SEQ ID NO: 3704 - RNA, 14 nt, Artificial Sequence
  synthetic oligonucleotide
aaggaagcacuuuc

SEQ ID NO: 3705 - RNA, 20 nt, Artificial Sequence
  synthetic oligonucleotide
cugcaaagggaagcccuuuc

SEQ ID NO: 3706 - RNA, 20 nt, Artificial Sequence
  synthetic oligonucleotide
cugcaaagggaagcccuuuc

SEQ ID NO: 3707 - RNA, 14 nt, Artificial Sequence
  synthetic oligonucleotide
gcuucccuuugcag

SEQ ID NO: 3708 - RNA, 22 nt, Artificial Sequence
  synthetic oligonucleotide
ccucccacacccaaggcuugca

SEQ ID NO: 3709 - RNA, 20 nt, Artificial Sequence
  synthetic oligonucleotide
ccucccacacccaaggcuug

SEQ ID NO: 3710 - RNA, 14 nt, Artificial Sequence
  synthetic oligonucleotide
uugggugugggagg

SEQ ID NO: 3711 - RNA, 22 nt, Artificial Sequence
  synthetic oligonucleotide
caugccuugaguguaggaccgu

SEQ ID NO: 3712 - RNA, 20 nt, Artificial Sequence
  synthetic oligonucleotide
caugccuugaguguaggacc

SEQ ID NO: 3713 - RNA, 14 nt, Artificial Sequence
  synthetic oligonucleotide
acacucaaggcaug

SEQ ID NO: 3714 - RNA, 22 nt, Artificial Sequence
  synthetic oligonucleotide
ggagaaauuauccuuggugugu

SEQ ID NO: 3715 - RNA, 20 nt, Artificial Sequence
  synthetic oligonucleotide
ggagaaauuauccuuggugu

SEQ ID NO: 3716 - RNA, 14 nt, Artificial Sequence
  synthetic oligonucleotide
aggauaauuucucc

SEQ ID NO: 3717 - RNA, 22 nt, Artificial Sequence
  synthetic oligonucleotide
uggugggcacagaaucuggacu

SEQ ID NO: 3718 - RNA, 20 nt, Artificial Sequence
  synthetic oligonucleotide
uggugggcacagaaucugga

SEQ ID NO: 3719 - RNA, 14 nt, Artificial Sequence
  synthetic oligonucleotide
uucugugcccacca

SEQ ID NO: 3720 - RNA, 25 nt, Artificial Sequence
  synthetic oligonucleotide
aaaggauucugcugucggucccacu

SEQ ID NO: 3721 - RNA, 20 nt, Artificial Sequence
  synthetic oligonucleotide
aaaggauucugcugucgguc

SEQ ID NO: 3722 - RNA, 14 nt, Artificial Sequence
  synthetic oligonucleotide
cagcagaauccuuu

SEQ ID NO: 3723 - RNA, 22 nt, Artificial Sequence
  synthetic oligonucleotide
ugugacagauugauaacugaaa

SEQ ID NO: 3724 - RNA, 20 nt, Artificial Sequence
  synthetic oligonucleotide
ugugacagauugauaacuga

SEQ ID NO: 3725 - RNA, 14 nt, Artificial Sequence
  synthetic oligonucleotide
aucaaucugucaca

SEQ ID NO: 3726 - RNA, 23 nt, Artificial Sequence
  synthetic oligonucleotide
ucggggaucaucaugucacgaga

SEQ ID NO: 3727 - RNA, 20 nt, Artificial Sequence
  synthetic oligonucleotide
ucggggaucaucaugucacg

SEQ ID NO: 3728 - RNA, 14 nt, Artificial Sequence
  synthetic oligonucleotide
augaugauccccga

SEQ ID NO: 3729 - RNA, 22 nt, Artificial Sequence
  synthetic oligonucleotide
aaacauucgcggugcacuucuu

SEQ ID NO: 3730 - RNA, 20 nt, Artificial Sequence
  synthetic oligonucleotide
aaacauucgcggugcacuuc

SEQ ID NO: 3731 - RNA, 14 nt, Artificial Sequence
  synthetic oligonucleotide
caccgcgaauguuu

SEQ ID NO: 3732 - RNA, 22 nt, Artificial Sequence
  synthetic oligonucleotide
auucugcauuuuuagcaaguuc

SEQ ID NO: 3733 - RNA, 20 nt, Artificial Sequence
  synthetic oligonucleotide
auucugcauuuuuagcaagu

SEQ ID NO: 3734 - RNA, 14 nt, Artificial Sequence
  synthetic oligonucleotide
uaaaaaugcagaau

SEQ ID NO: 3735 - RNA, 22 nt, Artificial Sequence
  synthetic oligonucleotide
accugagguugugcauuucuaa

SEQ ID NO: 3736 - RNA, 20 nt, Artificial Sequence
  synthetic oligonucleotide
accugagguugugcauuucu

SEQ ID NO: 3737 - RNA, 14 nt, Artificial Sequence
  synthetic oligonucleotide
gcacaaccucaggu

SEQ ID NO: 3738 - RNA, 22 nt, Artificial Sequence
  synthetic oligonucleotide
ucagcaaacauuuauugugugc

SEQ ID NO: 3739 - RNA, 20 nt, Artificial Sequence
  synthetic oligonucleotide
ucagcaaacauuuauugugu

SEQ ID NO: 3740 - RNA, 14 nt, Artificial Sequence
  synthetic oligonucleotide
uaaauguuugcuga

SEQ ID NO: 3741 - RNA, 22 nt, Artificial Sequence
  synthetic oligonucleotide
ucaguaaauguuuauuagauga

SEQ ID NO: 3742 - RNA, 20 nt, Artificial Sequence
  synthetic oligonucleotide
ucaguaaauguuuauuagau

SEQ ID NO: 3743 - RNA, 14 nt, Artificial Sequence
  synthetic oligonucleotide
uaaacauuuacuga

SEQ ID NO: 3744 - RNA, 22 nt, Artificial Sequence
  synthetic oligonucleotide
caaaacuggcaauuacuuuugc

SEQ ID NO: 3745 - RNA, 20 nt, Artificial Sequence
  synthetic oligonucleotide
caaaacuggcaauuacuuuu

SEQ ID NO: 3746 - RNA, 14 nt, Artificial Sequence
  synthetic oligonucleotide
aauugccaguuuug

SEQ ID NO: 3747 - RNA, 22 nt, Artificial Sequence
  synthetic oligonucleotide
aaaaguaauugcgaguuuuacc

SEQ ID NO: 3748 - RNA, 20 nt, Artificial Sequence
  synthetic oligonucleotide
aaaaguaauugcgaguuuua

SEQ ID NO: 3749 - RNA, 14 nt, Artificial Sequence
  synthetic oligonucleotide
ucgcaauuacuuuu

SEQ ID NO: 3750 - RNA, 25 nt, Artificial Sequence
  synthetic oligonucleotide
aaaaaccacaauuacuuuugcacca

SEQ ID NO: 3751 - RNA, 20 nt, Artificial Sequence
  synthetic oligonucleotide
aaaaaccacaauuacuuuug

SEQ ID NO: 3752 - RNA, 14 nt, Artificial Sequence
  synthetic oligonucleotide
uaauugugguuuuu

SEQ ID NO: 3753 - RNA, 22 nt, Artificial Sequence
  synthetic oligonucleotide
caagaaccucaguugcuuuugu

SEQ ID NO: 3754 - RNA, 20 nt, Artificial Sequence
  synthetic oligonucleotide
caagaaccucaguugcuuuu

SEQ ID NO: 3755 - RNA, 14 nt, Artificial Sequence
  synthetic oligonucleotide
aacugagguucuug

SEQ ID NO: 3756 - RNA, 22 nt, Artificial Sequence
  synthetic oligonucleotide
aaaaguaauugugguuuuggcc

SEQ ID NO: 3757 - RNA, 20 nt, Artificial Sequence
  synthetic oligonucleotide
aaaaguaauugugguuuugg

SEQ ID NO: 3758 - RNA, 14 nt, Artificial Sequence
  synthetic oligonucleotide
ccacaauuacuuuu

SEQ ID NO: 3759 - RNA, 22 nt, Artificial Sequence
  synthetic oligonucleotide
caaaaaucucaauuacuuuugc

SEQ ID NO: 3760 - RNA, 20 nt, Artificial Sequence
  synthetic oligonucleotide
caaaaaucucaauuacuuuu

SEQ ID NO: 3761 - RNA, 14 nt, Artificial Sequence
  synthetic oligonucleotide
aauugagauuuuug

SEQ ID NO: 3762 - RNA, 22 nt, Artificial Sequence
  synthetic oligonucleotide
aaaaguaauugcgguuuuugcc

SEQ ID NO: 3763 - RNA, 20 nt, Artificial Sequence
  synthetic oligonucleotide
aaaaguaauugcgguuuuug

SEQ ID NO: 3764 - RNA, 14 nt, Artificial Sequence
  synthetic oligonucleotide
ccgcaauuacuuuu

SEQ ID NO: 3765 - RNA, 22 nt, Artificial Sequence
  synthetic oligonucleotide
caaaaaccacaguuucuuuugc

SEQ ID NO: 3766 - RNA, 20 nt, Artificial Sequence
  synthetic oligonucleotide
caaaaaccacaguuucuuuu

SEQ ID NO: 3767 - RNA, 14 nt, Artificial Sequence
  synthetic oligonucleotide
aacugugguuuuug

SEQ ID NO: 3768 - RNA, 22 nt, Artificial Sequence
  synthetic oligonucleotide
aaaaguaauugugguuuuugcc

SEQ ID NO: 3769 - RNA, 20 nt, Artificial Sequence
  synthetic oligonucleotide
aaaaguaauugugguuuuug

SEQ ID NO: 3770 - RNA, 14 nt, Artificial Sequence
  synthetic oligonucleotide
ccacaauuacuuuu

SEQ ID NO: 3771 - RNA, 22 nt, Artificial Sequence
  synthetic oligonucleotide
aaaaacugagacuacuuuugca

SEQ ID NO: 3772 - RNA, 20 nt, Artificial Sequence
  synthetic oligonucleotide
aaaaacugagacuacuuuug

SEQ ID NO: 3773 - RNA, 14 nt, Artificial Sequence
  synthetic oligonucleotide
uagucucaguuuuu

SEQ ID NO: 3774 - RNA, 19 nt, Artificial Sequence
  synthetic oligonucleotide
aaaaacuguaauuacuuuu

SEQ ID NO: 3775 - RNA, 19 nt, Artificial Sequence
  synthetic oligonucleotide
aaaaacuguaauuacuuuu

SEQ ID NO: 3776 - RNA, 14 nt, Artificial Sequence
  synthetic oligonucleotide
uaauuacaguuuuu

SEQ ID NO: 3777 - RNA, 22 nt, Artificial Sequence
  synthetic oligonucleotide
aaaacuguaauuacuuuuguac

SEQ ID NO: 3778 - RNA, 20 nt, Artificial Sequence
  synthetic oligonucleotide
aaaacuguaauuacuuuugu

SEQ ID NO: 3779 - RNA, 14 nt, Artificial Sequence
  synthetic oligonucleotide
guaauuacaguuuu

SEQ ID NO: 3780 - RNA, 22 nt, Artificial Sequence
  synthetic oligonucleotide
aaaaguaaucgcgguuuuuguc

SEQ ID NO: 3781 - RNA, 20 nt, Artificial Sequence
  synthetic oligonucleotide
aaaaguaaucgcgguuuuug

SEQ ID NO: 3782 - RNA, 14 nt, Artificial Sequence
  synthetic oligonucleotide
ccgcgauuacuuuu

SEQ ID NO: 3783 - RNA, 22 nt, Artificial Sequence
  synthetic oligonucleotide
aaaaguaauugcggauuuugcc

SEQ ID NO: 3784 - RNA, 20 nt, Artificial Sequence
  synthetic oligonucleotide
aaaaguaauugcggauuuug

SEQ ID NO: 3785 - RNA, 14 nt, Artificial Sequence
  synthetic oligonucleotide
ccgcaauuacuuuu

SEQ ID NO: 3786 - RNA, 22 nt, Artificial Sequence
  synthetic oligonucleotide
aaaaguaauugcggucuuuggu

SEQ ID NO: 3787 - RNA, 20 nt, Artificial Sequence
  synthetic oligonucleotide
aaaaguaauugcggucuuug

SEQ ID NO: 3788 - RNA, 14 nt, Artificial Sequence
  synthetic oligonucleotide
ccgcaauuacuuuu

SEQ ID NO: 3789 - RNA, 22 nt, Artificial Sequence
  synthetic oligonucleotide
aaaaguacuugcggauuuugcu

SEQ ID NO: 3790 - RNA, 20 nt, Artificial Sequence
  synthetic oligonucleotide
aaaaguacuugcggauuuug

SEQ ID NO: 3791 - RNA, 14 nt, Artificial Sequence
  synthetic oligonucleotide
ccgcaaguacuuuu

SEQ ID NO: 3792 - RNA, 22 nt, Artificial Sequence
  synthetic oligonucleotide
aaaaguauuugcggguuuuguc

SEQ ID NO: 3793 - RNA, 20 nt, Artificial Sequence
  synthetic oligonucleotide
aaaaguauuugcggguuuug

SEQ ID NO: 3794 - RNA, 14 nt, Artificial Sequence
  synthetic oligonucleotide
ccgcaaauacuuuu

SEQ ID NO: 3795 - RNA, 21 nt, Artificial Sequence
  synthetic oligonucleotide
caaagguauuugugguuuuug

SEQ ID NO: 3796 - RNA, 20 nt, Artificial Sequence
  synthetic oligonucleotide
caaagguauuugugguuuuu

SEQ ID NO: 3797 - RNA, 14 nt, Artificial Sequence
  synthetic oligonucleotide
cacaaauaccuuug

SEQ ID NO: 3798 - RNA, 22 nt, Artificial Sequence
  synthetic oligonucleotide
caaaaguaauuguggauuuugu

SEQ ID NO: 3799 - RNA, 20 nt, Artificial Sequence
  synthetic oligonucleotide
caaaaguaauuguggauuuu

SEQ ID NO: 3800 - RNA, 14 nt, Artificial Sequence
  synthetic oligonucleotide
cacaauuacuuuug

SEQ ID NO: 3801 - RNA, 22 nt, Artificial Sequence
  synthetic oligonucleotide
ccaaaacugcaguuacuuuugc

SEQ ID NO: 3802 - RNA, 20 nt, Artificial Sequence
  synthetic oligonucleotide
ccaaaacugcaguuacuuuu

SEQ ID NO: 3803 - RNA, 14 nt, Artificial Sequence
  synthetic oligonucleotide
aacugcaguuuugg

SEQ ID NO: 3804 - RNA, 22 nt, Artificial Sequence
  synthetic oligonucleotide
uagcaaaaacugcaguuacuuu

SEQ ID NO: 3805 - RNA, 20 nt, Artificial Sequence
  synthetic oligonucleotide
uagcaaaaacugcaguuacu

SEQ ID NO: 3806 - RNA, 14 nt, Artificial Sequence
  synthetic oligonucleotide
ugcaguuuuugcua

SEQ ID NO: 3807 - RNA, 22 nt, Artificial Sequence
  synthetic oligonucleotide
gcuggugcaaaaguaauggcgg

SEQ ID NO: 3808 - RNA, 20 nt, Artificial Sequence
  synthetic oligonucleotide
gcuggugcaaaaguaauggc

SEQ ID NO: 3809 - RNA, 14 nt, Artificial Sequence
  synthetic oligonucleotide
acuuuugcaccagc

SEQ ID NO: 3810 - RNA, 23 nt, Artificial Sequence
  synthetic oligonucleotide
auggccaaaacugcaguuauuuu

SEQ ID NO: 3811 - RNA, 20 nt, Artificial Sequence
  synthetic oligonucleotide
auggccaaaacugcaguuau

SEQ ID NO: 3812 - RNA, 14 nt, Artificial Sequence
  synthetic oligonucleotide
gcaguuuuggccau

SEQ ID NO: 3813 - RNA, 21 nt, Artificial Sequence
  synthetic oligonucleotide
caaaagugaucgugguuuuug

SEQ ID NO: 3814 - RNA, 20 nt, Artificial Sequence
  synthetic oligonucleotide
caaaagugaucgugguuuuu

SEQ ID NO: 3815 - RNA, 14 nt, Artificial Sequence
  synthetic oligonucleotide
cacgaucacuuuug

SEQ ID NO: 3816 - RNA, 23 nt, Artificial Sequence
  synthetic oligonucleotide
caaagacugcaauuacuuuugcg

SEQ ID NO: 3817 - RNA, 20 nt, Artificial Sequence
  synthetic oligonucleotide
caaagacugcaauuacuuuu

SEQ ID NO: 3818 - RNA, 14 nt, Artificial Sequence
  synthetic oligonucleotide
aauugcagucuuug

SEQ ID NO: 3819 - RNA, 22 nt, Artificial Sequence
  synthetic oligonucleotide
agcuacaguuacuuuugcacca

SEQ ID NO: 3820 - RNA, 20 nt, Artificial Sequence
  synthetic oligonucleotide
agcuacaguuacuuuugcac

SEQ ID NO: 3821 - RNA, 14 nt, Artificial Sequence
  synthetic oligonucleotide
aaguaacuguagcu

SEQ ID NO: 3822 - RNA, 23 nt, Artificial Sequence
  synthetic oligonucleotide
aaaaguaacugcgguuuuugccu

SEQ ID NO: 3823 - RNA, 20 nt, Artificial Sequence
  synthetic oligonucleotide
aaaaguaacugcgguuuuug

SEQ ID NO: 3824 - RNA, 14 nt, Artificial Sequence
  synthetic oligonucleotide
ccgcaguuacuuuu

SEQ ID NO: 3825 - RNA, 21 nt, Artificial Sequence
  synthetic oligonucleotide
uaaaaacugcaauuacuuuca

SEQ ID NO: 3826 - RNA, 20 nt, Artificial Sequence
  synthetic oligonucleotide
uaaaaacugcaauuacuuuc

SEQ ID NO: 3827 - RNA, 14 nt, Artificial Sequence
  synthetic oligonucleotide
aauugcaguuuuua

SEQ ID NO: 3828 - RNA, 22 nt, Artificial Sequence
  synthetic oligonucleotide
aaaaguaaucacuguuuuugcc

SEQ ID NO: 3829 - RNA, 20 nt, Artificial Sequence
  synthetic oligonucleotide
aaaaguaaucacuguuuuug

SEQ ID NO: 3830 - RNA, 14 nt, Artificial Sequence
  synthetic oligonucleotide
cagugauuacuuuu

SEQ ID NO: 3831 - RNA, 23 nt, Artificial Sequence
  synthetic oligonucleotide
caaaaaccgcaauuacuuuugca

SEQ ID NO: 3832 - RNA, 20 nt, Artificial Sequence
  synthetic oligonucleotide
caaaaaccgcaauuacuuuu

SEQ ID NO: 3833 - RNA, 14 nt, Artificial Sequence
  synthetic oligonucleotide
aauugcgguuuuug

SEQ ID NO: 3834 - RNA, 21 nt, Artificial Sequence
  synthetic oligonucleotide
ugacaacuauggaugagcucu

SEQ ID NO: 3835 - RNA, 20 nt, Artificial Sequence
  synthetic oligonucleotide
ugacaacuauggaugagcuc

SEQ ID NO: 3836 - RNA, 14 nt, Artificial Sequence
  synthetic oligonucleotide
auccauaguuguca

SEQ ID NO: 3837 - RNA, 23 nt, Artificial Sequence
  synthetic oligonucleotide
agugccugagggaguaagagccc

SEQ ID NO: 3838 - RNA, 20 nt, Artificial Sequence
  synthetic oligonucleotide
agugccugagggaguaagag

SEQ ID NO: 3839 - RNA, 14 nt, Artificial Sequence
  synthetic oligonucleotide
cucccucaggcacu

SEQ ID NO: 3840 - RNA, 22 nt, Artificial Sequence
  synthetic oligonucleotide
ugucuuacucccucaggcacau

SEQ ID NO: 3841 - RNA, 20 nt, Artificial Sequence
  synthetic oligonucleotide
ugucuuacucccucaggcac

SEQ ID NO: 3842 - RNA, 14 nt, Artificial Sequence
  synthetic oligonucleotide
gagggaguaagaca

SEQ ID NO: 3843 - RNA, 20 nt, Artificial Sequence
  synthetic oligonucleotide
ucuuacucccucaggcacug

SEQ ID NO: 3844 - RNA, 20 nt, Artificial Sequence
  synthetic oligonucleotide
ucuuacucccucaggcacug

SEQ ID NO: 3845 - RNA, 14 nt, Artificial Sequence
  synthetic oligonucleotide
cugagggaguaaga

SEQ ID NO: 3846 - RNA, 21 nt, Artificial Sequence
  synthetic oligonucleotide
gcgacccacucuugguuucca

SEQ ID NO: 3847 - RNA, 20 nt, Artificial Sequence
  synthetic oligonucleotide
gcgacccacucuugguuucc

SEQ ID NO: 3848 - RNA, 14 nt, Artificial Sequence
  synthetic oligonucleotide
caagagugggucgc

SEQ ID NO: 3849 - RNA, 21 nt, Artificial Sequence
  synthetic oligonucleotide
gcgacccauacuugguuucag

SEQ ID NO: 3850 - RNA, 20 nt, Artificial Sequence
  synthetic oligonucleotide
gcgacccauacuugguuuca

SEQ ID NO: 3851 - RNA, 14 nt, Artificial Sequence
  synthetic oligonucleotide
caaguaugggucgc

SEQ ID NO: 3852 - RNA, 22 nt, Artificial Sequence
  synthetic oligonucleotide
gaaaucaagcgugggugagacc

SEQ ID NO: 3853 - RNA, 20 nt, Artificial Sequence
  synthetic oligonucleotide
gaaaucaagcgugggugaga

SEQ ID NO: 3854 - RNA, 14 nt, Artificial Sequence
  synthetic oligonucleotide
ccacgcuugauuuc

SEQ ID NO: 3855 - RNA, 21 nt, Artificial Sequence
  synthetic oligonucleotide
aacaggugacugguuagacaa

SEQ ID NO: 3856 - RNA, 20 nt, Artificial Sequence
  synthetic oligonucleotide
aacaggugacugguuagaca

SEQ ID NO: 3857 - RNA, 14 nt, Artificial Sequence
  synthetic oligonucleotide
accagucaccuguu

SEQ ID NO: 3858 - RNA, 21 nt, Artificial Sequence
  synthetic oligonucleotide
aaaacggugagauuuuguuuu

SEQ ID NO: 3859 - RNA, 20 nt, Artificial Sequence
  synthetic oligonucleotide
aaaacggugagauuuuguuu

SEQ ID NO: 3860 - RNA, 14 nt, Artificial Sequence
  synthetic oligonucleotide
aaucucaccguuuu

SEQ ID NO: 3861 - RNA, 21 nt, Artificial Sequence
  synthetic oligonucleotide
gcuaguccugacucagccagu

SEQ ID NO: 3862 - RNA, 20 nt, Artificial Sequence
  synthetic oligonucleotide
gcuaguccugacucagccag

SEQ ID NO: 3863 - RNA, 14 nt, Artificial Sequence
  synthetic oligonucleotide
gagucaggacuagc

SEQ ID NO: 3864 - RNA, 21 nt, Artificial Sequence
  synthetic oligonucleotide
aggguaagcugaaccucugau

SEQ ID NO: 3865 - RNA, 20 nt, Artificial Sequence
  synthetic oligonucleotide
aggguaagcugaaccucuga

SEQ ID NO: 3866 - RNA, 14 nt, Artificial Sequence
  synthetic oligonucleotide
guucagcuuacccu

SEQ ID NO: 3867 - RNA, 22 nt, Artificial Sequence
  synthetic oligonucleotide
auauuaccauuagcucaucuuu

SEQ ID NO: 3868 - RNA, 20 nt, Artificial Sequence
  synthetic oligonucleotide
auauuaccauuagcucaucu

SEQ ID NO: 3869 - RNA, 14 nt, Artificial Sequence
  synthetic oligonucleotide
gcuaaugguaauau

SEQ ID NO: 3870 - RNA, 22 nt, Artificial Sequence
  synthetic oligonucleotide
gaugagcucauuguaauaugag

SEQ ID NO: 3871 - RNA, 20 nt, Artificial Sequence
  synthetic oligonucleotide
gaugagcucauuguaauaug

SEQ ID NO: 3872 - RNA, 14 nt, Artificial Sequence
  synthetic oligonucleotide
acaaugagcucauc

SEQ ID NO: 3873 - RNA, 23 nt, Artificial Sequence
  synthetic oligonucleotide
guuugcacgggugggccuugucu

SEQ ID NO: 3874 - RNA, 20 nt, Artificial Sequence
  synthetic oligonucleotide
guuugcacgggugggccuug

SEQ ID NO: 3875 - RNA, 14 nt, Artificial Sequence
  synthetic oligonucleotide
ccacccgugcaaac

SEQ ID NO: 3876 - RNA, 19 nt, Artificial Sequence
  synthetic oligonucleotide
ugagcugcuguaccaaaau

SEQ ID NO: 3877 - RNA, 19 nt, Artificial Sequence
  synthetic oligonucleotide
ugagcugcuguaccaaaau

SEQ ID NO: 3878 - RNA, 14 nt, Artificial Sequence
  synthetic oligonucleotide
gguacagcagcuca

SEQ ID NO: 3879 - RNA, 21 nt, Artificial Sequence
  synthetic oligonucleotide
uaaaguaaauaugcaccaaaa

SEQ ID NO: 3880 - RNA, 20 nt, Artificial Sequence
  synthetic oligonucleotide
uaaaguaaauaugcaccaaa

SEQ ID NO: 3881 - RNA, 14 nt, Artificial Sequence
  synthetic oligonucleotide
gcauauuuacuuua

SEQ ID NO: 3882 - RNA, 22 nt, Artificial Sequence
  synthetic oligonucleotide
caaaguuuaagauccuugaagu

SEQ ID NO: 3883 - RNA, 20 nt, Artificial Sequence
  synthetic oligonucleotide
caaaguuuaagauccuugaa

SEQ ID NO: 3884 - RNA, 14 nt, Artificial Sequence
  synthetic oligonucleotide
gaucuuaaacuuug

SEQ ID NO: 3885 - RNA, 20 nt, Artificial Sequence
  synthetic oligonucleotide
aaaguagcuguaccauuugc

SEQ ID NO: 3886 - RNA, 20 nt, Artificial Sequence
  synthetic oligonucleotide
aaaguagcuguaccauuugc

SEQ ID NO: 3887 - RNA, 14 nt, Artificial Sequence
  synthetic oligonucleotide
gguacagcuacuuu

SEQ ID NO: 3888 - RNA, 19 nt, Artificial Sequence
  synthetic oligonucleotide
agguugacauacguuuccc

SEQ ID NO: 3889 - RNA, 19 nt, Artificial Sequence
  synthetic oligonucleotide
agguugacauacguuuccc

SEQ ID NO: 3890 - RNA, 14 nt, Artificial Sequence
  synthetic oligonucleotide
acguaugucaaccu

SEQ ID NO: 3891 - RNA, 19 nt, Artificial Sequence
  synthetic oligonucleotide
aggcacggugucagcaggc

SEQ ID NO: 3892 - RNA, 19 nt, Artificial Sequence
  synthetic oligonucleotide
aggcacggugucagcaggc

SEQ ID NO: 3893 - RNA, 14 nt, Artificial Sequence
  synthetic oligonucleotide
cugacaccgugccu

SEQ ID NO: 3894 - RNA, 19 nt, Artificial Sequence
  synthetic oligonucleotide
gggcgccugugaucccaac

SEQ ID NO: 3895 - RNA, 19 nt, Artificial Sequence
  synthetic oligonucleotide
gggcgccugugaucccaac

SEQ ID NO: 3896 - RNA, 14 nt, Artificial Sequence
  synthetic oligonucleotide
gaucacaggcgccc

SEQ ID NO: 3897 - RNA, 23 nt, Artificial Sequence
  synthetic oligonucleotide
aguauguucuuccaggacagaac

SEQ ID NO: 3898 - RNA, 20 nt, Artificial Sequence
  synthetic oligonucleotide
aguauguucuuccaggacag

SEQ ID NO: 3899 - RNA, 14 nt, Artificial Sequence
  synthetic oligonucleotide
uggaagaacauacu

SEQ ID NO: 3900 - RNA, 20 nt, Artificial Sequence
  synthetic oligonucleotide
auguauaaauguauacacac

SEQ ID NO: 3901 - RNA, 20 nt, Artificial Sequence
  synthetic oligonucleotide
auguauaaauguauacacac

SEQ ID NO: 3902 - RNA, 14 nt, Artificial Sequence
  synthetic oligonucleotide
auacauuuauacau

SEQ ID NO: 3903 - RNA, 21 nt, Artificial Sequence
  synthetic oligonucleotide
aguuaaugaauccuggaaagu

SEQ ID NO: 3904 - RNA, 20 nt, Artificial Sequence
  synthetic oligonucleotide
aguuaaugaauccuggaaag

SEQ ID NO: 3905 - RNA, 14 nt, Artificial Sequence
  synthetic oligonucleotide
aggauucauuaacu

SEQ ID NO: 3906 - RNA, 22 nt, Artificial Sequence
  synthetic oligonucleotide
cgaaaacagcaauuaccuuugc

SEQ ID NO: 3907 - RNA, 20 nt, Artificial Sequence
  synthetic oligonucleotide
cgaaaacagcaauuaccuuu

SEQ ID NO: 3908 - RNA, 14 nt, Artificial Sequence
  synthetic oligonucleotide
aauugcuguuuucg

SEQ ID NO: 3909 - RNA, 21 nt, Artificial Sequence
  synthetic oligonucleotide
ugaguuggccaucugagugag

SEQ ID NO: 3910 - RNA, 20 nt, Artificial Sequence
  synthetic oligonucleotide
ugaguuggccaucugaguga

SEQ ID NO: 3911 - RNA, 14 nt, Artificial Sequence
  synthetic oligonucleotide
agauggccaacuca

SEQ ID NO: 3912 - RNA, 20 nt, Artificial Sequence
  synthetic oligonucleotide
guccgcucggcgguggccca

SEQ ID NO: 3913 - RNA, 20 nt, Artificial Sequence
  synthetic oligonucleotide
guccgcucggcgguggccca

SEQ ID NO: 3914 - RNA, 14 nt, Artificial Sequence
  synthetic oligonucleotide
accgccgagcggac

SEQ ID NO: 3915 - RNA, 24 nt, Artificial Sequence
  synthetic oligonucleotide
cugaagugauguguaacugaucag

SEQ ID NO: 3916 - RNA, 20 nt, Artificial Sequence
  synthetic oligonucleotide
cugaagugauguguaacuga

SEQ ID NO: 3917 - RNA, 14 nt, Artificial Sequence
  synthetic oligonucleotide
acacaucacuucag

SEQ ID NO: 3918 - RNA, 22 nt, Artificial Sequence
  synthetic oligonucleotide
cacgcucaugcacacacccaca

SEQ ID NO: 3919 - RNA, 20 nt, Artificial Sequence
  synthetic oligonucleotide
cacgcucaugcacacaccca

SEQ ID NO: 3920 - RNA, 14 nt, Artificial Sequence
  synthetic oligonucleotide
ugugcaugagcgug

SEQ ID NO: 3921 - RNA, 23 nt, Artificial Sequence
  synthetic oligonucleotide
ugagugugugugugugagugugu

SEQ ID NO: 3922 - RNA, 20 nt, Artificial Sequence
  synthetic oligonucleotide
ugagugugugugugugagug

SEQ ID NO: 3923 - RNA, 14 nt, Artificial Sequence
  synthetic oligonucleotide
cacacacacacuca

SEQ ID NO: 3924 - RNA, 19 nt, Artificial Sequence
  synthetic oligonucleotide
gagccaguuggacaggagc

SEQ ID NO: 3925 - RNA, 19 nt, Artificial Sequence
  synthetic oligonucleotide
gagccaguuggacaggagc

SEQ ID NO: 3926 - RNA, 14 nt, Artificial Sequence
  synthetic oligonucleotide
uguccaacuggcuc

SEQ ID NO: 3927 - RNA, 22 nt, Artificial Sequence
  synthetic oligonucleotide
aagauguggaaaaauuggaauc

SEQ ID NO: 3928 - RNA, 20 nt, Artificial Sequence
  synthetic oligonucleotide
aagauguggaaaaauuggaa

SEQ ID NO: 3929 - RNA, 14 nt, Artificial Sequence
  synthetic oligonucleotide
uuuuuccacaucuu

SEQ ID NO: 3930 - RNA, 22 nt, Artificial Sequence
  synthetic oligonucleotide
auucuaauuucuccacgucuuu

SEQ ID NO: 3931 - RNA, 20 nt, Artificial Sequence
  synthetic oligonucleotide
auucuaauuucuccacgucu

SEQ ID NO: 3932 - RNA, 14 nt, Artificial Sequence
  synthetic oligonucleotide
ggagaaauuagaau

SEQ ID NO: 3933 - RNA, 21 nt, Artificial Sequence
  synthetic oligonucleotide
uagauaaaauauugguaccug

SEQ ID NO: 3934 - RNA, 20 nt, Artificial Sequence
  synthetic oligonucleotide
uagauaaaauauugguaccu

SEQ ID NO: 3935 - RNA, 14 nt, Artificial Sequence
  synthetic oligonucleotide
caauauuuuaucua

SEQ ID NO: 3936 - RNA, 21 nt, Artificial Sequence
  synthetic oligonucleotide
cuucuugugcucuaggauugu

SEQ ID NO: 3937 - RNA, 20 nt, Artificial Sequence
  synthetic oligonucleotide
cuucuugugcucuaggauug

SEQ ID NO: 3938 - RNA, 14 nt, Artificial Sequence
  synthetic oligonucleotide
uagagcacaagaag

SEQ ID NO: 3939 - RNA, 23 nt, Artificial Sequence
  synthetic oligonucleotide
uucauuugguauaaaccgcgauu

SEQ ID NO: 3940 - RNA, 20 nt, Artificial Sequence
  synthetic oligonucleotide
uucauuugguauaaaccgcg

SEQ ID NO: 3941 - RNA, 14 nt, Artificial Sequence
  synthetic oligonucleotide
uuauaccaaaugaa

SEQ ID NO: 3942 - RNA, 22 nt, Artificial Sequence
  synthetic oligonucleotide
uugagaaugaugaaucauuagg

SEQ ID NO: 3943 - RNA, 20 nt, Artificial Sequence
  synthetic oligonucleotide
uugagaaugaugaaucauua

SEQ ID NO: 3944 - RNA, 14 nt, Artificial Sequence
  synthetic oligonucleotide
uucaucauucucaa

SEQ ID NO: 3945 - RNA, 21 nt, Artificial Sequence
  synthetic oligonucleotide
ucuuguguucucuagaucagu

SEQ ID NO: 3946 - RNA, 20 nt, Artificial Sequence
  synthetic oligonucleotide
ucuuguguucucuagaucag

SEQ ID NO: 3947 - RNA, 14 nt, Artificial Sequence
  synthetic oligonucleotide
uagagaacacaaga

SEQ ID NO: 3948 - RNA, 22 nt, Artificial Sequence
  synthetic oligonucleotide
uaacugguugaacaacugaacc

SEQ ID NO: 3949 - RNA, 20 nt, Artificial Sequence
  synthetic oligonucleotide
uaacugguugaacaacugaa

SEQ ID NO: 3950 - RNA, 14 nt, Artificial Sequence
  synthetic oligonucleotide
uguucaaccaguua

SEQ ID NO: 3951 - RNA, 23 nt, Artificial Sequence
  synthetic oligonucleotide
uuacaguuguucaaccaguuacu

SEQ ID NO: 3952 - RNA, 20 nt, Artificial Sequence
  synthetic oligonucleotide
uuacaguuguucaaccaguu

SEQ ID NO: 3953 - RNA, 14 nt, Artificial Sequence
  synthetic oligonucleotide
uugaacaacuguaa

SEQ ID NO: 3954 - RNA, 21 nt, Artificial Sequence
  synthetic oligonucleotide
caaagaggaaggucccauuac

SEQ ID NO: 3955 - RNA, 20 nt, Artificial Sequence
  synthetic oligonucleotide
caaagaggaaggucccauua

SEQ ID NO: 3956 - RNA, 14 nt, Artificial Sequence
  synthetic oligonucleotide
gaccuuccucuuug

SEQ ID NO: 3957 - RNA, 22 nt, Artificial Sequence
  synthetic oligonucleotide
uuaugguuugccugggacugag

SEQ ID NO: 3958 - RNA, 20 nt, Artificial Sequence
  synthetic oligonucleotide
uuaugguuugccugggacug

SEQ ID NO: 3959 - RNA, 14 nt, Artificial Sequence
  synthetic oligonucleotide
caggcaaaccauaa

SEQ ID NO: 3960 - RNA, 19 nt, Artificial Sequence
  synthetic oligonucleotide
ugggcguaucuguaugcua

SEQ ID NO: 3961 - RNA, 19 nt, Artificial Sequence
  synthetic oligonucleotide
ugggcguaucuguaugcua

SEQ ID NO: 3962 - RNA, 14 nt, Artificial Sequence
  synthetic oligonucleotide
uacagauacgccca

SEQ ID NO: 3963 - RNA, 22 nt, Artificial Sequence
  synthetic oligonucleotide
uaugcauuguauuuuuaggucc

SEQ ID NO: 3964 - RNA, 20 nt, Artificial Sequence
  synthetic oligonucleotide
uaugcauuguauuuuuaggu

SEQ ID NO: 3965 - RNA, 14 nt, Artificial Sequence
  synthetic oligonucleotide
aaauacaaugcaua

SEQ ID NO: 3966 - RNA, 21 nt, Artificial Sequence
  synthetic oligonucleotide
uuuccauaggugaugagucac

SEQ ID NO: 3967 - RNA, 20 nt, Artificial Sequence
  synthetic oligonucleotide
uuuccauaggugaugaguca

SEQ ID NO: 3968 - RNA, 14 nt, Artificial Sequence
  synthetic oligonucleotide
aucaccuauggaaa

SEQ ID NO: 3969 - RNA, 21 nt, Artificial Sequence
  synthetic oligonucleotide
uuggccacaauggguuagaac

SEQ ID NO: 3970 - RNA, 20 nt, Artificial Sequence
  synthetic oligonucleotide
uuggccacaauggguuagaa

SEQ ID NO: 3971 - RNA, 14 nt, Artificial Sequence
  synthetic oligonucleotide
cccauuguggccaa

SEQ ID NO: 3972 - RNA, 22 nt, Artificial Sequence
  synthetic oligonucleotide
ugagaaccacgucugcucugag

SEQ ID NO: 3973 - RNA, 20 nt, Artificial Sequence
  synthetic oligonucleotide
ugagaaccacgucugcucug

SEQ ID NO: 3974 - RNA, 14 nt, Artificial Sequence
  synthetic oligonucleotide
agacgugguucuca

SEQ ID NO: 3975 - RNA, 24 nt, Artificial Sequence
  synthetic oligonucleotide
ucagaacaaaugccgguucccaga

SEQ ID NO: 3976 - RNA, 20 nt, Artificial Sequence
  synthetic oligonucleotide
ucagaacaaaugccgguucc

SEQ ID NO: 3977 - RNA, 14 nt, Artificial Sequence
  synthetic oligonucleotide
ggcauuuguucuga

SEQ ID NO: 3978 - RNA, 21 nt, Artificial Sequence
  synthetic oligonucleotide
uaauuuuauguauaagcuagu

SEQ ID NO: 3979 - RNA, 20 nt, Artificial Sequence
  synthetic oligonucleotide
uaauuuuauguauaagcuag

SEQ ID NO: 3980 - RNA, 14 nt, Artificial Sequence
  synthetic oligonucleotide
uauacauaaaauua

SEQ ID NO: 3981 - RNA, 22 nt, Artificial Sequence
  synthetic oligonucleotide
gagcuuauucauaaaagugcag

SEQ ID NO: 3982 - RNA, 20 nt, Artificial Sequence
  synthetic oligonucleotide
gagcuuauucauaaaagugc

SEQ ID NO: 3983 - RNA, 14 nt, Artificial Sequence
  synthetic oligonucleotide
uuaugaauaagcuc

SEQ ID NO: 3984 - RNA, 20 nt, Artificial Sequence
  synthetic oligonucleotide
agaccauggguucucauugu

SEQ ID NO: 3985 - RNA, 20 nt, Artificial Sequence
  synthetic oligonucleotide
agaccauggguucucauugu

SEQ ID NO: 3986 - RNA, 14 nt, Artificial Sequence
  synthetic oligonucleotide
agaacccauggucu

SEQ ID NO: 3987 - RNA, 22 nt, Artificial Sequence
  synthetic oligonucleotide
uugugucaauaugcgaugaugu

SEQ ID NO: 3988 - RNA, 20 nt, Artificial Sequence
  synthetic oligonucleotide
uugugucaauaugcgaugau

SEQ ID NO: 3989 - RNA, 14 nt, Artificial Sequence
  synthetic oligonucleotide
gcauauugacacaa

SEQ ID NO: 3990 - RNA, 19 nt, Artificial Sequence
  synthetic oligonucleotide
ugucucugcugggguuucu

SEQ ID NO: 3991 - RNA, 19 nt, Artificial Sequence
  synthetic oligonucleotide
ugucucugcugggguuucu

SEQ ID NO: 3992 - RNA, 14 nt, Artificial Sequence
  synthetic oligonucleotide
ccccagcagagaca

SEQ ID NO: 3993 - RNA, 25 nt, Artificial Sequence
  synthetic oligonucleotide
aggcaccagccaggcauugcucagc

SEQ ID NO: 3994 - RNA, 20 nt, Artificial Sequence
  synthetic oligonucleotide
aggcaccagccaggcauugc

SEQ ID NO: 3995 - RNA, 14 nt, Artificial Sequence
  synthetic oligonucleotide
ccuggcuggugccu

SEQ ID NO: 3996 - RNA, 21 nt, Artificial Sequence
  synthetic oligonucleotide
gaagugugccguggugugucu

SEQ ID NO: 3997 - RNA, 20 nt, Artificial Sequence
  synthetic oligonucleotide
gaagugugccgugguguguc

SEQ ID NO: 3998 - RNA, 14 nt, Artificial Sequence
  synthetic oligonucleotide
ccacggcacacuuc

SEQ ID NO: 3999 - RNA, 21 nt, Artificial Sequence
  synthetic oligonucleotide
aagccugcccggcuccucggg

SEQ ID NO: 4000 - RNA, 20 nt, Artificial Sequence
  synthetic oligonucleotide
aagccugcccggcuccucgg

SEQ ID NO: 4001 - RNA, 14 nt, Artificial Sequence
  synthetic oligonucleotide
agccgggcaggcuu

SEQ ID NO: 4002 - RNA, 22 nt, Artificial Sequence
  synthetic oligonucleotide
ugugucacucgaugaccacugu

SEQ ID NO: 4003 - RNA, 20 nt, Artificial Sequence
  synthetic oligonucleotide
ugugucacucgaugaccacu

SEQ ID NO: 4004 - RNA, 14 nt, Artificial Sequence
  synthetic oligonucleotide
caucgagugacaca

SEQ ID NO: 4005 - RNA, 22 nt, Artificial Sequence
  synthetic oligonucleotide
uacgucaucguugucaucguca

SEQ ID NO: 4006 - RNA, 20 nt, Artificial Sequence
  synthetic oligonucleotide
uacgucaucguugucaucgu

SEQ ID NO: 4007 - RNA, 14 nt, Artificial Sequence
  synthetic oligonucleotide
acaacgaugacgua

SEQ ID NO: 4008 - RNA, 20 nt, Artificial Sequence
  synthetic oligonucleotide
guugugucaguuuaucaaac

SEQ ID NO: 4009 - RNA, 20 nt, Artificial Sequence
  synthetic oligonucleotide
guugugucaguuuaucaaac

SEQ ID NO: 4010 - RNA, 14 nt, Artificial Sequence
  synthetic oligonucleotide
uaaacugacacaac

SEQ ID NO: 4011 - RNA, 23 nt, Artificial Sequence
  synthetic oligonucleotide
acuuacagacaagagccuugcuc

SEQ ID NO: 4012 - RNA, 20 nt, Artificial Sequence
  synthetic oligonucleotide
acuuacagacaagagccuug

SEQ ID NO: 4013 - RNA, 14 nt, Artificial Sequence
  synthetic oligonucleotide
ucuugucuguaagu

SEQ ID NO: 4014 - RNA, 22 nt, Artificial Sequence
  synthetic oligonucleotide
uggucuaggauuguuggaggag

SEQ ID NO: 4015 - RNA, 20 nt, Artificial Sequence
  synthetic oligonucleotide
uggucuaggauuguuggagg

SEQ ID NO: 4016 - RNA, 14 nt, Artificial Sequence
  synthetic oligonucleotide
acaauccuagacca

SEQ ID NO: 4017 - RNA, 23 nt, Artificial Sequence
  synthetic oligonucleotide
gacacgggcgacagcugcggccc

SEQ ID NO: 4018 - RNA, 20 nt, Artificial Sequence
  synthetic oligonucleotide
gacacgggcgacagcugcgg

SEQ ID NO: 4019 - RNA, 14 nt, Artificial Sequence
  synthetic oligonucleotide
cugucgcccguguc

SEQ ID NO: 4020 - RNA, 22 nt, Artificial Sequence
  synthetic oligonucleotide
cacacacugcaauuacuuuugc

SEQ ID NO: 4021 - RNA, 20 nt, Artificial Sequence
  synthetic oligonucleotide
cacacacugcaauuacuuuu

SEQ ID NO: 4022 - RNA, 14 nt, Artificial Sequence
  synthetic oligonucleotide
aauugcagugugug

SEQ ID NO: 4023 - RNA, 19 nt, Artificial Sequence
  synthetic oligonucleotide
aggcugcggaauucaggac

SEQ ID NO: 4024 - RNA, 19 nt, Artificial Sequence
  synthetic oligonucleotide
aggcugcggaauucaggac

SEQ ID NO: 4025 - RNA, 14 nt, Artificial Sequence
  synthetic oligonucleotide
gaauuccgcagccu

SEQ ID NO: 4026 - RNA, 23 nt, Artificial Sequence
  synthetic oligonucleotide
uaaaucccauggugccuucuccu

SEQ ID NO: 4027 - RNA, 20 nt, Artificial Sequence
  synthetic oligonucleotide
uaaaucccauggugccuucu

SEQ ID NO: 4028 - RNA, 14 nt, Artificial Sequence
  synthetic oligonucleotide
caccaugggauuua

SEQ ID NO: 4029 - RNA, 21 nt, Artificial Sequence
  synthetic oligonucleotide
aaacuacugaaaaucaaagau

SEQ ID NO: 4030 - RNA, 20 nt, Artificial Sequence
  synthetic oligonucleotide
aaacuacugaaaaucaaaga

SEQ ID NO: 4031 - RNA, 14 nt, Artificial Sequence
  synthetic oligonucleotide
auuuucaguaguuu

SEQ ID NO: 4032 - RNA, 21 nt, Artificial Sequence
  synthetic oligonucleotide
guucaaauccagaucuauaac

SEQ ID NO: 4033 - RNA, 20 nt, Artificial Sequence
  synthetic oligonucleotide
guucaaauccagaucuauaa

SEQ ID NO: 4034 - RNA, 14 nt, Artificial Sequence
  synthetic oligonucleotide
aucuggauuugaac

SEQ ID NO: 4035 - RNA, 25 nt, Artificial Sequence
  synthetic oligonucleotide
aggggugguguugggacagcuccgu

SEQ ID NO: 4036 - RNA, 20 nt, Artificial Sequence
  synthetic oligonucleotide
aggggugguguugggacagc

SEQ ID NO: 4037 - RNA, 14 nt, Artificial Sequence
  synthetic oligonucleotide
ccaacaccaccccu

SEQ ID NO: 4038 - RNA, 20 nt, Artificial Sequence
  synthetic oligonucleotide
aggguguuucucucaucucu

SEQ ID NO: 4039 - RNA, 20 nt, Artificial Sequence
  synthetic oligonucleotide
aggguguuucucucaucucu

SEQ ID NO: 4040 - RNA, 14 nt, Artificial Sequence
  synthetic oligonucleotide
gagagaaacacccu

SEQ ID NO: 4041 - RNA, 21 nt, Artificial Sequence
  synthetic oligonucleotide
ugagcuaaaugugugcuggga

SEQ ID NO: 4042 - RNA, 20 nt, Artificial Sequence
  synthetic oligonucleotide
ugagcuaaaugugugcuggg

SEQ ID NO: 4043 - RNA, 14 nt, Artificial Sequence
  synthetic oligonucleotide
acacauuuagcuca

SEQ ID NO: 4044 - RNA, 23 nt, Artificial Sequence
  synthetic oligonucleotide
gcgaggaccccucggggucugac

SEQ ID NO: 4045 - RNA, 20 nt, Artificial Sequence
  synthetic oligonucleotide
gcgaggaccccucggggucu

SEQ ID NO: 4046 - RNA, 14 nt, Artificial Sequence
  synthetic oligonucleotide
cgagggguccucgc

SEQ ID NO: 4047 - RNA, 25 nt, Artificial Sequence
  synthetic oligonucleotide
gcugggcagggcuucugagcuccuu

SEQ ID NO: 4048 - RNA, 20 nt, Artificial Sequence
  synthetic oligonucleotide
gcugggcagggcuucugagc

SEQ ID NO: 4049 - RNA, 14 nt, Artificial Sequence
  synthetic oligonucleotide
aagcccugcccagc

SEQ ID NO: 4050 - RNA, 20 nt, Artificial Sequence
  synthetic oligonucleotide
aggaauguuccuucuuugcc

SEQ ID NO: 4051 - RNA, 20 nt, Artificial Sequence
  synthetic oligonucleotide
aggaauguuccuucuuugcc

SEQ ID NO: 4052 - RNA, 14 nt, Artificial Sequence
  synthetic oligonucleotide
gaaggaacauuccu

SEQ ID NO: 4053 - RNA, 23 nt, Artificial Sequence
  synthetic oligonucleotide
gaacgccuguucuugccaggugg

SEQ ID NO: 4054 - RNA, 20 nt, Artificial Sequence
  synthetic oligonucleotide
gaacgccuguucuugccagg

SEQ ID NO: 4055 - RNA, 14 nt, Artificial Sequence
  synthetic oligonucleotide
aagaacaggcguuc

SEQ ID NO: 4056 - RNA, 22 nt, Artificial Sequence
  synthetic oligonucleotide
uccgagccugggucucccucuu

SEQ ID NO: 4057 - RNA, 20 nt, Artificial Sequence
  synthetic oligonucleotide
uccgagccugggucucccuc

SEQ ID NO: 4058 - RNA, 14 nt, Artificial Sequence
  synthetic oligonucleotide
gacccaggcucgga

SEQ ID NO: 4059 - RNA, 22 nt, Artificial Sequence
  synthetic oligonucleotide
ggggguccccggugcucggauc

SEQ ID NO: 4060 - RNA, 20 nt, Artificial Sequence
  synthetic oligonucleotide
ggggguccccggugcucgga

SEQ ID NO: 4061 - RNA, 14 nt, Artificial Sequence
  synthetic oligonucleotide
caccggggaccccc

SEQ ID NO: 4062 - RNA, 22 nt, Artificial Sequence
  synthetic oligonucleotide
agucauuggaggguuugagcag

SEQ ID NO: 4063 - RNA, 20 nt, Artificial Sequence
  synthetic oligonucleotide
agucauuggaggguuugagc

SEQ ID NO: 4064 - RNA, 14 nt, Artificial Sequence
  synthetic oligonucleotide
acccuccaaugacu

SEQ ID NO: 4065 - RNA, 22 nt, Artificial Sequence
  synthetic oligonucleotide
acucaaaacccuucagugacuu

SEQ ID NO: 4066 - RNA, 20 nt, Artificial Sequence
  synthetic oligonucleotide
acucaaaacccuucagugac

SEQ ID NO: 4067 - RNA, 14 nt, Artificial Sequence
  synthetic oligonucleotide
gaaggguuuugagu

SEQ ID NO: 4068 - RNA, 22 nt, Artificial Sequence
  synthetic oligonucleotide
agacuucccauuugaagguggc

SEQ ID NO: 4069 - RNA, 20 nt, Artificial Sequence
  synthetic oligonucleotide
agacuucccauuugaaggug

SEQ ID NO: 4070 - RNA, 14 nt, Artificial Sequence
  synthetic oligonucleotide
caaaugggaagucu

SEQ ID NO: 4071 - RNA, 23 nt, Artificial Sequence
  synthetic oligonucleotide
aaacucuacuuguccuucugagu

SEQ ID NO: 4072 - RNA, 20 nt, Artificial Sequence
  synthetic oligonucleotide
aaacucuacuuguccuucug

SEQ ID NO: 4073 - RNA, 14 nt, Artificial Sequence
  synthetic oligonucleotide
gacaaguagaguuu

SEQ ID NO: 4074 - RNA, 24 nt, Artificial Sequence
  synthetic oligonucleotide
gaccuggacauguuugugcccagu

SEQ ID NO: 4075 - RNA, 20 nt, Artificial Sequence
  synthetic oligonucleotide
gaccuggacauguuugugcc

SEQ ID NO: 4076 - RNA, 14 nt, Artificial Sequence
  synthetic oligonucleotide
aacauguccagguc

SEQ ID NO: 4077 - RNA, 20 nt, Artificial Sequence
  synthetic oligonucleotide
auggagauagauauagaaau

SEQ ID NO: 4078 - RNA, 20 nt, Artificial Sequence
  synthetic oligonucleotide
auggagauagauauagaaau

SEQ ID NO: 4079 - RNA, 14 nt, Artificial Sequence
  synthetic oligonucleotide
auaucuaucuccau

SEQ ID NO: 4080 - RNA, 21 nt, Artificial Sequence
  synthetic oligonucleotide
ggcuagcaacagcgcuuaccu

SEQ ID NO: 4081 - RNA, 20 nt, Artificial Sequence
  synthetic oligonucleotide
ggcuagcaacagcgcuuacc

SEQ ID NO: 4082 - RNA, 14 nt, Artificial Sequence
  synthetic oligonucleotide
cgcuguugcuagcc

SEQ ID NO: 4083 - RNA, 21 nt, Artificial Sequence
  synthetic oligonucleotide
acagucugcugagguuggagc

SEQ ID NO: 4084 - RNA, 20 nt, Artificial Sequence
  synthetic oligonucleotide
acagucugcugagguuggag

SEQ ID NO: 4085 - RNA, 14 nt, Artificial Sequence
  synthetic oligonucleotide
ccucagcagacugu

SEQ ID NO: 4086 - RNA, 23 nt, Artificial Sequence
  synthetic oligonucleotide
aucccuugcaggggcuguugggu

SEQ ID NO: 4087 - RNA, 20 nt, Artificial Sequence
  synthetic oligonucleotide
aucccuugcaggggcuguug

SEQ ID NO: 4088 - RNA, 14 nt, Artificial Sequence
  synthetic oligonucleotide
ccccugcaagggau

SEQ ID NO: 4089 - RNA, 21 nt, Artificial Sequence
  synthetic oligonucleotide
cacaagguauugguauuaccu

SEQ ID NO: 4090 - RNA, 20 nt, Artificial Sequence
  synthetic oligonucleotide
cacaagguauugguauuacc

SEQ ID NO: 4091 - RNA, 14 nt, Artificial Sequence
  synthetic oligonucleotide
accaauaccuugug

SEQ ID NO: 4092 - RNA, 22 nt, Artificial Sequence
  synthetic oligonucleotide
uaguaccaguaccuuguguuca

SEQ ID NO: 4093 - RNA, 20 nt, Artificial Sequence
  synthetic oligonucleotide
uaguaccaguaccuuguguu

SEQ ID NO: 4094 - RNA, 14 nt, Artificial Sequence
  synthetic oligonucleotide
agguacugguacua

SEQ ID NO: 4095 - RNA, 21 nt, Artificial Sequence
  synthetic oligonucleotide
agggggaaaguucuauagucc

SEQ ID NO: 4096 - RNA, 20 nt, Artificial Sequence
  synthetic oligonucleotide
agggggaaaguucuauaguc

SEQ ID NO: 4097 - RNA, 14 nt, Artificial Sequence
  synthetic oligonucleotide
agaacuuucccccu

SEQ ID NO: 4098 - RNA, 22 nt, Artificial Sequence
  synthetic oligonucleotide
gacuauagaacuuucccccuca

SEQ ID NO: 4099 - RNA, 20 nt, Artificial Sequence
  synthetic oligonucleotide
gacuauagaacuuucccccu

SEQ ID NO: 4100 - RNA, 14 nt, Artificial Sequence
  synthetic oligonucleotide
aaaguucuauaguc

SEQ ID NO: 4101 - RNA, 19 nt, Artificial Sequence
  synthetic oligonucleotide
agcugucugaaaaugucuu

SEQ ID NO: 4102 - RNA, 19 nt, Artificial Sequence
  synthetic oligonucleotide
agcugucugaaaaugucuu

SEQ ID NO: 4103 - RNA, 14 nt, Artificial Sequence
  synthetic oligonucleotide
auuuucagacagcu

SEQ ID NO: 4104 - RNA, 22 nt, Artificial Sequence
  synthetic oligonucleotide
gugagucucuaagaaaagagga

SEQ ID NO: 4105 - RNA, 20 nt, Artificial Sequence
  synthetic oligonucleotide
gugagucucuaagaaaagag

SEQ ID NO: 4106 - RNA, 14 nt, Artificial Sequence
  synthetic oligonucleotide
ucuuagagacucac

SEQ ID NO: 4107 - RNA, 21 nt, Artificial Sequence
  synthetic oligonucleotide
ucuaguaagaguggcagucga

SEQ ID NO: 4108 - RNA, 20 nt, Artificial Sequence
  synthetic oligonucleotide
ucuaguaagaguggcagucg

SEQ ID NO: 4109 - RNA, 14 nt, Artificial Sequence
  synthetic oligonucleotide
ccacucuuacuaga

SEQ ID NO: 4110 - RNA, 22 nt, Artificial Sequence
  synthetic oligonucleotide
augcugacauauuuacuagagg

SEQ ID NO: 4111 - RNA, 20 nt, Artificial Sequence
  synthetic oligonucleotide
augcugacauauuuacuaga

SEQ ID NO: 4112 - RNA, 14 nt, Artificial Sequence
  synthetic oligonucleotide
aaauaugucagcau

SEQ ID NO: 4113 - RNA, 21 nt, Artificial Sequence
  synthetic oligonucleotide
uggguuuacguugggagaacu

SEQ ID NO: 4114 - RNA, 20 nt, Artificial Sequence
  synthetic oligonucleotide
uggguuuacguugggagaac

SEQ ID NO: 4115 - RNA, 14 nt, Artificial Sequence
  synthetic oligonucleotide
ccaacguaaaccca

SEQ ID NO: 4116 - RNA, 22 nt, Artificial Sequence
  synthetic oligonucleotide
guucucccaacguaagcccagc

SEQ ID NO: 4117 - RNA, 20 nt, Artificial Sequence
  synthetic oligonucleotide
guucucccaacguaagccca

SEQ ID NO: 4118 - RNA, 14 nt, Artificial Sequence
  synthetic oligonucleotide
uacguugggagaac

SEQ ID NO: 4119 - RNA, 22 nt, Artificial Sequence
  synthetic oligonucleotide
aguauucuguaccagggaaggu

SEQ ID NO: 4120 - RNA, 20 nt, Artificial Sequence
  synthetic oligonucleotide
aguauucuguaccagggaag

SEQ ID NO: 4121 - RNA, 14 nt, Artificial Sequence
  synthetic oligonucleotide
ugguacagaauacu

SEQ ID NO: 4122 - RNA, 21 nt, Artificial Sequence
  synthetic oligonucleotide
agaccuggcccagaccucagc

SEQ ID NO: 4123 - RNA, 20 nt, Artificial Sequence
  synthetic oligonucleotide
agaccuggcccagaccucag

SEQ ID NO: 4124 - RNA, 14 nt, Artificial Sequence
  synthetic oligonucleotide
ucugggccaggucu

SEQ ID NO: 4125 - RNA, 19 nt, Artificial Sequence
  synthetic oligonucleotide
gugucugcuuccuguggga

SEQ ID NO: 4126 - RNA, 19 nt, Artificial Sequence
  synthetic oligonucleotide
gugucugcuuccuguggga

SEQ ID NO: 4127 - RNA, 14 nt, Artificial Sequence
  synthetic oligonucleotide
caggaagcagacac

SEQ ID NO: 4128 - RNA, 23 nt, Artificial Sequence
  synthetic oligonucleotide
cuaauaguaucuaccacaauaaa

SEQ ID NO: 4129 - RNA, 20 nt, Artificial Sequence
  synthetic oligonucleotide
cuaauaguaucuaccacaau

SEQ ID NO: 4130 - RNA, 14 nt, Artificial Sequence
  synthetic oligonucleotide
guagauacuauuag

SEQ ID NO: 4131 - RNA, 22 nt, Artificial Sequence
  synthetic oligonucleotide
aaccagcaccccaacuuuggac

SEQ ID NO: 4132 - RNA, 20 nt, Artificial Sequence
  synthetic oligonucleotide
aaccagcaccccaacuuugg

SEQ ID NO: 4133 - RNA, 14 nt, Artificial Sequence
  synthetic oligonucleotide
uuggggugcugguu

SEQ ID NO: 4134 - RNA, 23 nt, Artificial Sequence
  synthetic oligonucleotide
acuugggcacugaaacaaugucc

SEQ ID NO: 4135 - RNA, 20 nt, Artificial Sequence
  synthetic oligonucleotide
acuugggcacugaaacaaug

SEQ ID NO: 4136 - RNA, 14 nt, Artificial Sequence
  synthetic oligonucleotide
uucagugcccaagu

SEQ ID NO: 4137 - RNA, 23 nt, Artificial Sequence
  synthetic oligonucleotide
ugugcuugcucgucccgcccgca

SEQ ID NO: 4138 - RNA, 20 nt, Artificial Sequence
  synthetic oligonucleotide
ugugcuugcucgucccgccc

SEQ ID NO: 4139 - RNA, 14 nt, Artificial Sequence
  synthetic oligonucleotide
gacgagcaagcaca

SEQ ID NO: 4140 - RNA, 24 nt, Artificial Sequence
  synthetic oligonucleotide
acugggggcuuucgggcucugcgu

SEQ ID NO: 4141 - RNA, 20 nt, Artificial Sequence
  synthetic oligonucleotide
acugggggcuuucgggcucu

SEQ ID NO: 4142 - RNA, 14 nt, Artificial Sequence
  synthetic oligonucleotide
cgaaagcccccagu

SEQ ID NO: 4143 - RNA, 25 nt, Artificial Sequence
  synthetic oligonucleotide
agggaucgcgggcggguggcggccu

SEQ ID NO: 4144 - RNA, 20 nt, Artificial Sequence
  synthetic oligonucleotide
agggaucgcgggcggguggc

SEQ ID NO: 4145 - RNA, 14 nt, Artificial Sequence
  synthetic oligonucleotide
cgcccgcgaucccu

SEQ ID NO: 4146 - RNA, 23 nt, Artificial Sequence
  synthetic oligonucleotide
aucgcugcgguugcgagcgcugu

SEQ ID NO: 4147 - RNA, 20 nt, Artificial Sequence
  synthetic oligonucleotide
aucgcugcgguugcgagcgc

SEQ ID NO: 4148 - RNA, 14 nt, Artificial Sequence
  synthetic oligonucleotide
gcaaccgcagcgau

SEQ ID NO: 4149 - RNA, 21 nt, Artificial Sequence
  synthetic oligonucleotide
augauccaggaaccugccucu

SEQ ID NO: 4150 - RNA, 20 nt, Artificial Sequence
  synthetic oligonucleotide
augauccaggaaccugccuc

SEQ ID NO: 4151 - RNA, 14 nt, Artificial Sequence
  synthetic oligonucleotide
gguuccuggaucau

SEQ ID NO: 4152 - RNA, 24 nt, Artificial Sequence
  synthetic oligonucleotide
aaagacauaggauagagucaccuc

SEQ ID NO: 4153 - RNA, 20 nt, Artificial Sequence
  synthetic oligonucleotide
aaagacauaggauagaguca

SEQ ID NO: 4154 - RNA, 14 nt, Artificial Sequence
  synthetic oligonucleotide
uauccuaugucuuu

SEQ ID NO: 4155 - RNA, 22 nt, Artificial Sequence
  synthetic oligonucleotide
gucccucuccaaaugugucuug

SEQ ID NO: 4156 - RNA, 20 nt, Artificial Sequence
  synthetic oligonucleotide
gucccucuccaaaugugucu

SEQ ID NO: 4157 - RNA, 14 nt, Artificial Sequence
  synthetic oligonucleotide
auuuggagagggac

SEQ ID NO: 4158 - RNA, 22 nt, Artificial Sequence
  synthetic oligonucleotide
agacacauuuggagagggaccc

SEQ ID NO: 4159 - RNA, 20 nt, Artificial Sequence
  synthetic oligonucleotide
agacacauuuggagagggac

SEQ ID NO: 4160 - RNA, 14 nt, Artificial Sequence
  synthetic oligonucleotide
cuccaaaugugucu

SEQ ID NO: 4161 - RNA, 22 nt, Artificial Sequence
  synthetic oligonucleotide
acuuguaugcuagcucagguag

SEQ ID NO: 4162 - RNA, 20 nt, Artificial Sequence
  synthetic oligonucleotide
acuuguaugcuagcucaggu

SEQ ID NO: 4163 - RNA, 14 nt, Artificial Sequence
  synthetic oligonucleotide
gcuagcauacaagu

SEQ ID NO: 4164 - RNA, 19 nt, Artificial Sequence
  synthetic oligonucleotide
aguguggcuuucuuagagc

SEQ ID NO: 4165 - RNA, 19 nt, Artificial Sequence
  synthetic oligonucleotide
aguguggcuuucuuagagc

SEQ ID NO: 4166 - RNA, 14 nt, Artificial Sequence
  synthetic oligonucleotide
aagaaagccacacu

SEQ ID NO: 4167 - RNA, 19 nt, Artificial Sequence
  synthetic oligonucleotide
ucuaggcugguacugcuga

SEQ ID NO: 4168 - RNA, 19 nt, Artificial Sequence
  synthetic oligonucleotide
ucuaggcugguacugcuga

SEQ ID NO: 4169 - RNA, 14 nt, Artificial Sequence
  synthetic oligonucleotide
aguaccagccuaga

SEQ ID NO: 4170 - RNA, 19 nt, Artificial Sequence
  synthetic oligonucleotide
aagcagcugccucugaggc

SEQ ID NO: 4171 - RNA, 19 nt, Artificial Sequence
  synthetic oligonucleotide
aagcagcugccucugaggc

SEQ ID NO: 4172 - RNA, 14 nt, Artificial Sequence
  synthetic oligonucleotide
agaggcagcugcuu

SEQ ID NO: 4173 - RNA, 21 nt, Artificial Sequence
  synthetic oligonucleotide
guggcugcacucacuuccuuc

SEQ ID NO: 4174 - RNA, 20 nt, Artificial Sequence
  synthetic oligonucleotide
guggcugcacucacuuccuu

SEQ ID NO: 4175 - RNA, 14 nt, Artificial Sequence
  synthetic oligonucleotide
gugagugcagccac

SEQ ID NO: 4176 - RNA, 19 nt, Artificial Sequence
  synthetic oligonucleotide
aagugugcagggcacuggu

SEQ ID NO: 4177 - RNA, 19 nt, Artificial Sequence
  synthetic oligonucleotide
aagugugcagggcacuggu

SEQ ID NO: 4178 - RNA, 14 nt, Artificial Sequence
  synthetic oligonucleotide
ugcccugcacacuu

SEQ ID NO: 4179 - RNA, 22 nt, Artificial Sequence
  synthetic oligonucleotide
aaaccuguguuguucaagaguc

SEQ ID NO: 4180 - RNA, 20 nt, Artificial Sequence
  synthetic oligonucleotide
aaaccuguguuguucaagag

SEQ ID NO: 4181 - RNA, 14 nt, Artificial Sequence
  synthetic oligonucleotide
aacaacacagguuu

SEQ ID NO: 4182 - RNA, 21 nt, Artificial Sequence
  synthetic oligonucleotide
aggaggcagcgcucucaggac

SEQ ID NO: 4183 - RNA, 20 nt, Artificial Sequence
  synthetic oligonucleotide
aggaggcagcgcucucagga

SEQ ID NO: 4184 - RNA, 14 nt, Artificial Sequence
  synthetic oligonucleotide
gagcgcugccuccu

SEQ ID NO: 4185 - RNA, 22 nt, Artificial Sequence
  synthetic oligonucleotide
uuuaggauaagcuugacuuuug

SEQ ID NO: 4186 - RNA, 20 nt, Artificial Sequence
  synthetic oligonucleotide
uuuaggauaagcuugacuuu

SEQ ID NO: 4187 - RNA, 14 nt, Artificial Sequence
  synthetic oligonucleotide
aagcuuauccuaaa

SEQ ID NO: 4188 - RNA, 21 nt, Artificial Sequence
  synthetic oligonucleotide
aauggcgccacuaggguugug

SEQ ID NO: 4189 - RNA, 20 nt, Artificial Sequence
  synthetic oligonucleotide
aauggcgccacuaggguugu

SEQ ID NO: 4190 - RNA, 14 nt, Artificial Sequence
  synthetic oligonucleotide
cuaguggcgccauu

SEQ ID NO: 4191 - RNA, 21 nt, Artificial Sequence
  synthetic oligonucleotide
guguugaaacaaucucuacug

SEQ ID NO: 4192 - RNA, 20 nt, Artificial Sequence
  synthetic oligonucleotide
guguugaaacaaucucuacu

SEQ ID NO: 4193 - RNA, 14 nt, Artificial Sequence
  synthetic oligonucleotide
gauuguuucaacac

SEQ ID NO: 4194 - RNA, 22 nt, Artificial Sequence
  synthetic oligonucleotide
uaugucugcugaccaucaccuu

SEQ ID NO: 4195 - RNA, 20 nt, Artificial Sequence
  synthetic oligonucleotide
uaugucugcugaccaucacc

SEQ ID NO: 4196 - RNA, 14 nt, Artificial Sequence
  synthetic oligonucleotide
ggucagcagacaua

SEQ ID NO: 4197 - RNA, 22 nt, Artificial Sequence
  synthetic oligonucleotide
uggugggccgcagaacaugugc

SEQ ID NO: 4198 - RNA, 20 nt, Artificial Sequence
  synthetic oligonucleotide
uggugggccgcagaacaugu

SEQ ID NO: 4199 - RNA, 14 nt, Artificial Sequence
  synthetic oligonucleotide
ucugcggcccacca

SEQ ID NO: 4200 - RNA, 22 nt, Artificial Sequence
  synthetic oligonucleotide
auaauacaugguuaaccucuuu

SEQ ID NO: 4201 - RNA, 20 nt, Artificial Sequence
  synthetic oligonucleotide
auaauacaugguuaaccucu

SEQ ID NO: 4202 - RNA, 14 nt, Artificial Sequence
  synthetic oligonucleotide
uaaccauguauuau

SEQ ID NO: 4203 - RNA, 21 nt, Artificial Sequence
  synthetic oligonucleotide
aauauuauacagucaaccucu

SEQ ID NO: 4204 - RNA, 20 nt, Artificial Sequence
  synthetic oligonucleotide
aauauuauacagucaaccuc

SEQ ID NO: 4205 - RNA, 14 nt, Artificial Sequence
  synthetic oligonucleotide
gacuguauaauauu

SEQ ID NO: 4206 - RNA, 23 nt, Artificial Sequence
  synthetic oligonucleotide
ggcagguucucacccucucuagg

SEQ ID NO: 4207 - RNA, 20 nt, Artificial Sequence
  synthetic oligonucleotide
ggcagguucucacccucucu

SEQ ID NO: 4208 - RNA, 14 nt, Artificial Sequence
  synthetic oligonucleotide
ggugagaaccugcc

SEQ ID NO: 4209 - RNA, 25 nt, Artificial Sequence
  synthetic oligonucleotide
ggcggagggaaguagguccguuggu

SEQ ID NO: 4210 - RNA, 20 nt, Artificial Sequence
  synthetic oligonucleotide
ggcggagggaaguagguccg

SEQ ID NO: 4211 - RNA, 14 nt, Artificial Sequence
  synthetic oligonucleotide
uacuucccuccgcc

SEQ ID NO: 4212 - RNA, 22 nt, Artificial Sequence
  synthetic oligonucleotide
cuugguucagggagggucccca

SEQ ID NO: 4213 - RNA, 20 nt, Artificial Sequence
  synthetic oligonucleotide
cuugguucagggaggguccc

SEQ ID NO: 4214 - RNA, 14 nt, Artificial Sequence
  synthetic oligonucleotide
cucccugaaccaag

SEQ ID NO: 4215 - RNA, 22 nt, Artificial Sequence
  synthetic oligonucleotide
uacccauugcauaucggaguug

SEQ ID NO: 4216 - RNA, 20 nt, Artificial Sequence
  synthetic oligonucleotide
uacccauugcauaucggagu

SEQ ID NO: 4217 - RNA, 14 nt, Artificial Sequence
  synthetic oligonucleotide
auaugcaaugggua

SEQ ID NO: 4218 - RNA, 24 nt, Artificial Sequence
  synthetic oligonucleotide
ugccugggucucuggccugcgcgu

SEQ ID NO: 4219 - RNA, 20 nt, Artificial Sequence
  synthetic oligonucleotide
ugccugggucucuggccugc

SEQ ID NO: 4220 - RNA, 14 nt, Artificial Sequence
  synthetic oligonucleotide
cagagacccaggca

SEQ ID NO: 4221 - RNA, 21 nt, Artificial Sequence
  synthetic oligonucleotide
ucccacguuguggcccagcag

SEQ ID NO: 4222 - RNA, 20 nt, Artificial Sequence
  synthetic oligonucleotide
ucccacguuguggcccagca

SEQ ID NO: 4223 - RNA, 14 nt, Artificial Sequence
  synthetic oligonucleotide
gccacaacguggga

SEQ ID NO: 4224 - RNA, 22 nt, Artificial Sequence
  synthetic oligonucleotide
aggcggggcgccgcgggaccgc

SEQ ID NO: 4225 - RNA, 20 nt, Artificial Sequence
  synthetic oligonucleotide
aggcggggcgccgcgggacc

SEQ ID NO: 4226 - RNA, 14 nt, Artificial Sequence
  synthetic oligonucleotide
gcggcgccccgccu

SEQ ID NO: 4227 - RNA, 22 nt, Artificial Sequence
  synthetic oligonucleotide
gguggcccggccgugccugagg

SEQ ID NO: 4228 - RNA, 20 nt, Artificial Sequence
  synthetic oligonucleotide
gguggcccggccgugccuga

SEQ ID NO: 4229 - RNA, 14 nt, Artificial Sequence
  synthetic oligonucleotide
acggccgggccacc

SEQ ID NO: 4230 - RNA, 23 nt, Artificial Sequence
  synthetic oligonucleotide
uauucauuuauccccagccuaca

SEQ ID NO: 4231 - RNA, 20 nt, Artificial Sequence
  synthetic oligonucleotide
uauucauuuauccccagccu

SEQ ID NO: 4232 - RNA, 14 nt, Artificial Sequence
  synthetic oligonucleotide
gggauaaaugaaua

SEQ ID NO: 4233 - RNA, 24 nt, Artificial Sequence
  synthetic oligonucleotide
acuggcuagggaaaaugauuggau

SEQ ID NO: 4234 - RNA, 20 nt, Artificial Sequence
  synthetic oligonucleotide
acuggcuagggaaaaugauu

SEQ ID NO: 4235 - RNA, 14 nt, Artificial Sequence
  synthetic oligonucleotide
uuucccuagccagu

SEQ ID NO: 4236 - RNA, 20 nt, Artificial Sequence
  synthetic oligonucleotide
accaggaggcugaggccccu

SEQ ID NO: 4237 - RNA, 20 nt, Artificial Sequence
  synthetic oligonucleotide
accaggaggcugaggccccu

SEQ ID NO: 4238 - RNA, 14 nt, Artificial Sequence
  synthetic oligonucleotide
cucagccuccuggu

SEQ ID NO: 4239 - RNA, 23 nt, Artificial Sequence
  synthetic oligonucleotide
ugucacucggcucggcccacuac

SEQ ID NO: 4240 - RNA, 20 nt, Artificial Sequence
  synthetic oligonucleotide
ugucacucggcucggcccac

SEQ ID NO: 4241 - RNA, 14 nt, Artificial Sequence
  synthetic oligonucleotide
cgagccgagugaca

SEQ ID NO: 4242 - RNA, 20 nt, Artificial Sequence
  synthetic oligonucleotide
gucccugaguguauguggug

SEQ ID NO: 4243 - RNA, 20 nt, Artificial Sequence
  synthetic oligonucleotide
gucccugaguguauguggug

SEQ ID NO: 4244 - RNA, 14 nt, Artificial Sequence
  synthetic oligonucleotide
auacacucagggac

SEQ ID NO: 4245 - RNA, 21 nt, Artificial Sequence
  synthetic oligonucleotide
uccgguucucagggcuccacc

SEQ ID NO: 4246 - RNA, 20 nt, Artificial Sequence
  synthetic oligonucleotide
uccgguucucagggcuccac

SEQ ID NO: 4247 - RNA, 14 nt, Artificial Sequence
  synthetic oligonucleotide
cccugagaaccgga

SEQ ID NO: 4248 - RNA, 23 nt, Artificial Sequence
  synthetic oligonucleotide
aggaagcccuggaggggcuggag

SEQ ID NO: 4249 - RNA, 20 nt, Artificial Sequence
  synthetic oligonucleotide
aggaagcccuggaggggcug

SEQ ID NO: 4250 - RNA, 14 nt, Artificial Sequence
  synthetic oligonucleotide
cuccagggcuuccu

SEQ ID NO: 4251 - RNA, 23 nt, Artificial Sequence
  synthetic oligonucleotide
uggugcggagagggcccacagug

SEQ ID NO: 4252 - RNA, 20 nt, Artificial Sequence
  synthetic oligonucleotide
uggugcggagagggcccaca

SEQ ID NO: 4253 - RNA, 14 nt, Artificial Sequence
  synthetic oligonucleotide
cccucuccgcacca

SEQ ID NO: 4254 - RNA, 20 nt, Artificial Sequence
  synthetic oligonucleotide
cuguaugcccucaccgcuca

SEQ ID NO: 4255 - RNA, 20 nt, Artificial Sequence
  synthetic oligonucleotide
cuguaugcccucaccgcuca

SEQ ID NO: 4256 - RNA, 14 nt, Artificial Sequence
  synthetic oligonucleotide
gugagggcauacag

SEQ ID NO: 4257 - RNA, 21 nt, Artificial Sequence
  synthetic oligonucleotide
cuguccuaagguuguugaguu

SEQ ID NO: 4258 - RNA, 20 nt, Artificial Sequence
  synthetic oligonucleotide
cuguccuaagguuguugagu

SEQ ID NO: 4259 - RNA, 14 nt, Artificial Sequence
  synthetic oligonucleotide
caaccuuaggacag

SEQ ID NO: 4260 - RNA, 21 nt, Artificial Sequence
  synthetic oligonucleotide
ucuucaaccucaggacuugca

SEQ ID NO: 4261 - RNA, 20 nt, Artificial Sequence
  synthetic oligonucleotide
ucuucaaccucaggacuugc

SEQ ID NO: 4262 - RNA, 14 nt, Artificial Sequence
  synthetic oligonucleotide
ccugagguugaaga

SEQ ID NO: 4263 - RNA, 23 nt, Artificial Sequence
  synthetic oligonucleotide
uggaagacuagugauuuuguugu

SEQ ID NO: 4264 - RNA, 20 nt, Artificial Sequence
  synthetic oligonucleotide
uggaagacuagugauuuugu

SEQ ID NO: 4265 - RNA, 14 nt, Artificial Sequence
  synthetic oligonucleotide
ucacuagucuucca

SEQ ID NO: 4266 - RNA, 23 nt, Artificial Sequence
  synthetic oligonucleotide
aaggagcuuacaaucuagcuggg

SEQ ID NO: 4267 - RNA, 20 nt, Artificial Sequence
  synthetic oligonucleotide
aaggagcuuacaaucuagcu

SEQ ID NO: 4268 - RNA, 14 nt, Artificial Sequence
  synthetic oligonucleotide
auuguaagcuccuu

SEQ ID NO: 4269 - RNA, 22 nt, Artificial Sequence
  synthetic oligonucleotide
caacuagacugugagcuucuag

SEQ ID NO: 4270 - RNA, 20 nt, Artificial Sequence
  synthetic oligonucleotide
caacuagacugugagcuucu

SEQ ID NO: 4271 - RNA, 14 nt, Artificial Sequence
  synthetic oligonucleotide
ucacagucuaguug

SEQ ID NO: 4272 - RNA, 22 nt, Artificial Sequence
  synthetic oligonucleotide
caacaaaucacagucugccaua

SEQ ID NO: 4273 - RNA, 20 nt, Artificial Sequence
  synthetic oligonucleotide
caacaaaucacagucugcca

SEQ ID NO: 4274 - RNA, 14 nt, Artificial Sequence
  synthetic oligonucleotide
acugugauuuguug

SEQ ID NO: 4275 - RNA, 22 nt, Artificial Sequence
  synthetic oligonucleotide
gggacccagggagagacguaag

SEQ ID NO: 4276 - RNA, 20 nt, Artificial Sequence
  synthetic oligonucleotide
gggacccagggagagacgua

SEQ ID NO: 4277 - RNA, 14 nt, Artificial Sequence
  synthetic oligonucleotide
ucucccuggguccc

SEQ ID NO: 4278 - RNA, 21 nt, Artificial Sequence
  synthetic oligonucleotide
cuuccgccccgccgggcgucg

SEQ ID NO: 4279 - RNA, 20 nt, Artificial Sequence
  synthetic oligonucleotide
cuuccgccccgccgggcguc

SEQ ID NO: 4280 - RNA, 14 nt, Artificial Sequence
  synthetic oligonucleotide
cggcggggcggaag

SEQ ID NO: 4281 - RNA, 22 nt, Artificial Sequence
  synthetic oligonucleotide
caacaaaucccagucuaccuaa

SEQ ID NO: 4282 - RNA, 20 nt, Artificial Sequence
  synthetic oligonucleotide
caacaaaucccagucuaccu

SEQ ID NO: 4283 - RNA, 14 nt, Artificial Sequence
  synthetic oligonucleotide
acugggauuuguug

SEQ ID NO: 4284 - RNA, 17 nt, Artificial Sequence
  synthetic oligonucleotide
ucucgcuggggccucca

SEQ ID NO: 4285 - RNA, 17 nt, Artificial Sequence
  synthetic oligonucleotide
ucucgcuggggccucca

SEQ ID NO: 4286 - RNA, 14 nt, Artificial Sequence
  synthetic oligonucleotide
aggccccagcgaga

SEQ ID NO: 4287 - RNA, 22 nt, Artificial Sequence
  synthetic oligonucleotide
ugcggggcuagggcuaacagca

SEQ ID NO: 4288 - RNA, 20 nt, Artificial Sequence
  synthetic oligonucleotide
ugcggggcuagggcuaacag

SEQ ID NO: 4289 - RNA, 14 nt, Artificial Sequence
  synthetic oligonucleotide
gcccuagccccgca

SEQ ID NO: 4290 - RNA, 22 nt, Artificial Sequence
  synthetic oligonucleotide
cuguugccacuaaccucaaccu

SEQ ID NO: 4291 - RNA, 20 nt, Artificial Sequence
  synthetic oligonucleotide
cuguugccacuaaccucaac

SEQ ID NO: 4292 - RNA, 14 nt, Artificial Sequence
  synthetic oligonucleotide
guuaguggcaacag

SEQ ID NO: 4293 - RNA, 22 nt, Artificial Sequence
  synthetic oligonucleotide
uuugugaccugguccacuaacc

SEQ ID NO: 4294 - RNA, 20 nt, Artificial Sequence
  synthetic oligonucleotide
uuugugaccugguccacuaa

SEQ ID NO: 4295 - RNA, 14 nt, Artificial Sequence
  synthetic oligonucleotide
gaccaggucacaaa

SEQ ID NO: 4296 - RNA, 22 nt, Artificial Sequence
  synthetic oligonucleotide
gcagagugcaaacaauuuugac

SEQ ID NO: 4297 - RNA, 20 nt, Artificial Sequence
  synthetic oligonucleotide
gcagagugcaaacaauuuug

SEQ ID NO: 4298 - RNA, 14 nt, Artificial Sequence
  synthetic oligonucleotide
uguuugcacucugc

SEQ ID NO: 4299 - RNA, 20 nt, Artificial Sequence
  synthetic oligonucleotide
cggcucugggucugugggga

SEQ ID NO: 4300 - RNA, 20 nt, Artificial Sequence
  synthetic oligonucleotide
cggcucugggucugugggga

SEQ ID NO: 4301 - RNA, 14 nt, Artificial Sequence
  synthetic oligonucleotide
cagacccagagccg

SEQ ID NO: 4302 - RNA, 22 nt, Artificial Sequence
  synthetic oligonucleotide
gcagcagggugaaacugacaca

SEQ ID NO: 4303 - RNA, 20 nt, Artificial Sequence
  synthetic oligonucleotide
gcagcagggugaaacugaca

SEQ ID NO: 4304 - RNA, 14 nt, Artificial Sequence
  synthetic oligonucleotide
uuucacccugcugc

SEQ ID NO: 4305 - RNA, 22 nt, Artificial Sequence
  synthetic oligonucleotide
ggggcuggggccggggccgagc

SEQ ID NO: 4306 - RNA, 20 nt, Artificial Sequence
  synthetic oligonucleotide
ggggcuggggccggggccga

SEQ ID NO: 4307 - RNA, 14 nt, Artificial Sequence
  synthetic oligonucleotide
ccggccccagcccc

SEQ ID NO: 4308 - RNA, 22 nt, Artificial Sequence
  synthetic oligonucleotide
gcaggugcucacuuguccuccu

SEQ ID NO: 4309 - RNA, 20 nt, Artificial Sequence
  synthetic oligonucleotide
gcaggugcucacuuguccuc

SEQ ID NO: 4310 - RNA, 14 nt, Artificial Sequence
  synthetic oligonucleotide
aagugagcaccugc

SEQ ID NO: 4311 - RNA, 21 nt, Artificial Sequence
  synthetic oligonucleotide
uggaggagaaggaaggugaug

SEQ ID NO: 4312 - RNA, 20 nt, Artificial Sequence
  synthetic oligonucleotide
uggaggagaaggaaggugau

SEQ ID NO: 4313 - RNA, 14 nt, Artificial Sequence
  synthetic oligonucleotide
uuccuucuccucca

SEQ ID NO: 4314 - RNA, 22 nt, Artificial Sequence
  synthetic oligonucleotide
acuccagccccacagccucagc

SEQ ID NO: 4315 - RNA, 20 nt, Artificial Sequence
  synthetic oligonucleotide
acuccagccccacagccuca

SEQ ID NO: 4316 - RNA, 14 nt, Artificial Sequence
  synthetic oligonucleotide
uguggggcuggagu

SEQ ID NO: 4317 - RNA, 23 nt, Artificial Sequence
  synthetic oligonucleotide
ucugcucauaccccaugguuucu

SEQ ID NO: 4318 - RNA, 20 nt, Artificial Sequence
  synthetic oligonucleotide
ucugcucauaccccaugguu

SEQ ID NO: 4319 - RNA, 14 nt, Artificial Sequence
  synthetic oligonucleotide
gggguaugagcaga

SEQ ID NO: 4320 - RNA, 23 nt, Artificial Sequence
  synthetic oligonucleotide
ugcaccaugguugucugagcaug

SEQ ID NO: 4321 - RNA, 20 nt, Artificial Sequence
  synthetic oligonucleotide
ugcaccaugguugucugagc

SEQ ID NO: 4322 - RNA, 14 nt, Artificial Sequence
  synthetic oligonucleotide
acaaccauggugca

SEQ ID NO: 4323 - RNA, 23 nt, Artificial Sequence
  synthetic oligonucleotide
cugggaucuccggggucuugguu

SEQ ID NO: 4324 - RNA, 20 nt, Artificial Sequence
  synthetic oligonucleotide
cugggaucuccggggucuug

SEQ ID NO: 4325 - RNA, 14 nt, Artificial Sequence
  synthetic oligonucleotide
cccggagaucccag

SEQ ID NO: 4326 - RNA, 22 nt, Artificial Sequence
  synthetic oligonucleotide
ugagaccucuggguucugagcu

SEQ ID NO: 4327 - RNA, 20 nt, Artificial Sequence
  synthetic oligonucleotide
ugagaccucuggguucugag

SEQ ID NO: 4328 - RNA, 14 nt, Artificial Sequence
  synthetic oligonucleotide
acccagaggucuca

SEQ ID NO: 4329 - RNA, 23 nt, Artificial Sequence
  synthetic oligonucleotide
uccaguaccacgugucagggcca

SEQ ID NO: 4330 - RNA, 20 nt, Artificial Sequence
  synthetic oligonucleotide
uccaguaccacgugucaggg

SEQ ID NO: 4331 - RNA, 14 nt, Artificial Sequence
  synthetic oligonucleotide
cacgugguacugga

SEQ ID NO: 4332 - RNA, 23 nt, Artificial Sequence
  synthetic oligonucleotide
caguaacaaagauucauccuugu

SEQ ID NO: 4333 - RNA, 20 nt, Artificial Sequence
  synthetic oligonucleotide
caguaacaaagauucauccu

SEQ ID NO: 4334 - RNA, 14 nt, Artificial Sequence
  synthetic oligonucleotide
aaucuuuguuacug

SEQ ID NO: 4335 - RNA, 21 nt, Artificial Sequence
  synthetic oligonucleotide
gcaggaacuugugagucuccu

SEQ ID NO: 4336 - RNA, 20 nt, Artificial Sequence
  synthetic oligonucleotide
gcaggaacuugugagucucc

SEQ ID NO: 4337 - RNA, 14 nt, Artificial Sequence
  synthetic oligonucleotide
ucacaaguuccugc

SEQ ID NO: 4338 - RNA, 22 nt, Artificial Sequence
  synthetic oligonucleotide
cugcccuggcccgagggaccga

SEQ ID NO: 4339 - RNA, 20 nt, Artificial Sequence
  synthetic oligonucleotide
cugcccuggcccgagggacc

SEQ ID NO: 4340 - RNA, 14 nt, Artificial Sequence
  synthetic oligonucleotide
ucgggccagggcag

SEQ ID NO: 4341 - RNA, 21 nt, Artificial Sequence
  synthetic oligonucleotide
ccuggaaacacugagguugug

SEQ ID NO: 4342 - RNA, 20 nt, Artificial Sequence
  synthetic oligonucleotide
ccuggaaacacugagguugu

SEQ ID NO: 4343 - RNA, 14 nt, Artificial Sequence
  synthetic oligonucleotide
ucaguguuuccagg

SEQ ID NO: 4344 - RNA, 22 nt, Artificial Sequence
  synthetic oligonucleotide
uauaccucaguuuuaucaggug

SEQ ID NO: 4345 - RNA, 20 nt, Artificial Sequence
  synthetic oligonucleotide
uauaccucaguuuuaucagg

SEQ ID NO: 4346 - RNA, 14 nt, Artificial Sequence
  synthetic oligonucleotide
aaaacugagguaua

SEQ ID NO: 4347 - RNA, 22 nt, Artificial Sequence
  synthetic oligonucleotide
uggugguuuacaaaguaauuca

SEQ ID NO: 4348 - RNA, 20 nt, Artificial Sequence
  synthetic oligonucleotide
uggugguuuacaaaguaauu

SEQ ID NO: 4349 - RNA, 14 nt, Artificial Sequence
  synthetic oligonucleotide
uuuguaaaccacca

SEQ ID NO: 4350 - RNA, 22 nt, Artificial Sequence
  synthetic oligonucleotide
uggauuucuuugugaaucacca

SEQ ID NO: 4351 - RNA, 20 nt, Artificial Sequence
  synthetic oligonucleotide
uggauuucuuugugaaucac

SEQ ID NO: 4352 - RNA, 14 nt, Artificial Sequence
  synthetic oligonucleotide
cacaaagaaaucca

SEQ ID NO: 4353 - RNA, 20 nt, Artificial Sequence
  synthetic oligonucleotide
guagaggagauggcgcaggg

SEQ ID NO: 4354 - RNA, 20 nt, Artificial Sequence
  synthetic oligonucleotide
guagaggagauggcgcaggg

SEQ ID NO: 4355 - RNA, 14 nt, Artificial Sequence
  synthetic oligonucleotide
gccaucuccucuac

SEQ ID NO: 4356 - RNA, 21 nt, Artificial Sequence
  synthetic oligonucleotide
uccucuucucccuccucccag

SEQ ID NO: 4357 - RNA, 20 nt, Artificial Sequence
  synthetic oligonucleotide
uccucuucucccuccuccca

SEQ ID NO: 4358 - RNA, 14 nt, Artificial Sequence
  synthetic oligonucleotide
gagggagaagagga

SEQ ID NO: 4359 - RNA, 22 nt, Artificial Sequence
  synthetic oligonucleotide
aggcagcgggguguaguggaua

SEQ ID NO: 4360 - RNA, 20 nt, Artificial Sequence
  synthetic oligonucleotide
aggcagcgggguguagugga

SEQ ID NO: 4361 - RNA, 14 nt, Artificial Sequence
  synthetic oligonucleotide
acaccccgcugccu

SEQ ID NO: 4362 - RNA, 22 nt, Artificial Sequence
  synthetic oligonucleotide
uccauuacacuacccugccucu

SEQ ID NO: 4363 - RNA, 20 nt, Artificial Sequence
  synthetic oligonucleotide
uccauuacacuacccugccu

SEQ ID NO: 4364 - RNA, 14 nt, Artificial Sequence
  synthetic oligonucleotide
gguaguguaaugga

SEQ ID NO: 4365 - RNA, 22 nt, Artificial Sequence
  synthetic oligonucleotide
gugaacgggcgccaucccgagg

SEQ ID NO: 4366 - RNA, 20 nt, Artificial Sequence
  synthetic oligonucleotide
gugaacgggcgccaucccga

SEQ ID NO: 4367 - RNA, 14 nt, Artificial Sequence
  synthetic oligonucleotide
uggcgcccguucac

SEQ ID NO: 4368 - RNA, 21 nt, Artificial Sequence
  synthetic oligonucleotide
uacucaaaaagcugucaguca

SEQ ID NO: 4369 - RNA, 20 nt, Artificial Sequence
  synthetic oligonucleotide
uacucaaaaagcugucaguc

SEQ ID NO: 4370 - RNA, 14 nt, Artificial Sequence
  synthetic oligonucleotide
cagcuuuuugagua

SEQ ID NO: 4371 - RNA, 22 nt, Artificial Sequence
  synthetic oligonucleotide
gacugacaccucuuugggugaa

SEQ ID NO: 4372 - RNA, 20 nt, Artificial Sequence
  synthetic oligonucleotide
gacugacaccucuuugggug

SEQ ID NO: 4373 - RNA, 14 nt, Artificial Sequence
  synthetic oligonucleotide
aagaggugucaguc

SEQ ID NO: 4374 - RNA, 21 nt, Artificial Sequence
  synthetic oligonucleotide
uuaauaucggacaaccauugu

SEQ ID NO: 4375 - RNA, 20 nt, Artificial Sequence
  synthetic oligonucleotide
uuaauaucggacaaccauug

SEQ ID NO: 4376 - RNA, 14 nt, Artificial Sequence
  synthetic oligonucleotide
uuguccgauauuaa

SEQ ID NO: 4377 - RNA, 21 nt, Artificial Sequence
  synthetic oligonucleotide
uacuuggaaaggcaucaguug

SEQ ID NO: 4378 - RNA, 20 nt, Artificial Sequence
  synthetic oligonucleotide
uacuuggaaaggcaucaguu

SEQ ID NO: 4379 - RNA, 14 nt, Artificial Sequence
  synthetic oligonucleotide
ugccuuuccaagua

SEQ ID NO: 4380 - RNA, 22 nt, Artificial Sequence
  synthetic oligonucleotide
ugcaacgaaccugagccacuga

SEQ ID NO: 4381 - RNA, 20 nt, Artificial Sequence
  synthetic oligonucleotide
ugcaacgaaccugagccacu

SEQ ID NO: 4382 - RNA, 14 nt, Artificial Sequence
  synthetic oligonucleotide
ucagguucguugca

SEQ ID NO: 4383 - RNA, 22 nt, Artificial Sequence
  synthetic oligonucleotide
ugcaacuuaccugagucauuga

SEQ ID NO: 4384 - RNA, 20 nt, Artificial Sequence
  synthetic oligonucleotide
ugcaacuuaccugagucauu

SEQ ID NO: 4385 - RNA, 14 nt, Artificial Sequence
  synthetic oligonucleotide
ucagguaaguugca

SEQ ID NO: 4386 - RNA, 21 nt, Artificial Sequence
  synthetic oligonucleotide
cacuguguccuuucugcguag

SEQ ID NO: 4387 - RNA, 20 nt, Artificial Sequence
  synthetic oligonucleotide
cacuguguccuuucugcgua

SEQ ID NO: 4388 - RNA, 14 nt, Artificial Sequence
  synthetic oligonucleotide
gaaaggacacagug

SEQ ID NO: 4389 - RNA, 22 nt, Artificial Sequence
  synthetic oligonucleotide
cacuggcuccuuucuggguaga

SEQ ID NO: 4390 - RNA, 20 nt, Artificial Sequence
  synthetic oligonucleotide
cacuggcuccuuucugggua

SEQ ID NO: 4391 - RNA, 14 nt, Artificial Sequence
  synthetic oligonucleotide
gaaaggagccagug

SEQ ID NO: 4392 - RNA, 23 nt, Artificial Sequence
  synthetic oligonucleotide
ucuuugguuaucuagcuguauga

SEQ ID NO: 4393 - RNA, 20 nt, Artificial Sequence
  synthetic oligonucleotide
ucuuugguuaucuagcugua

SEQ ID NO: 4394 - RNA, 14 nt, Artificial Sequence
  synthetic oligonucleotide
uagauaaccaaaga

SEQ ID NO: 4395 - RNA, 22 nt, Artificial Sequence
  synthetic oligonucleotide
auaaagcuagauaaccgaaagu

SEQ ID NO: 4396 - RNA, 20 nt, Artificial Sequence
  synthetic oligonucleotide
auaaagcuagauaaccgaaa

SEQ ID NO: 4397 - RNA, 14 nt, Artificial Sequence
  synthetic oligonucleotide
uuaucuagcuuuau

SEQ ID NO: 4398 - RNA, 20 nt, Artificial Sequence
  synthetic oligonucleotide
ggggagcuguggaagcagua

SEQ ID NO: 4399 - RNA, 20 nt, Artificial Sequence
  synthetic oligonucleotide
ggggagcuguggaagcagua

SEQ ID NO: 4400 - RNA, 14 nt, Artificial Sequence
  synthetic oligonucleotide
uuccacagcucccc

SEQ ID NO: 4401 - RNA, 25 nt, Artificial Sequence
  synthetic oligonucleotide
cuagugagggacagaaccaggauuc

SEQ ID NO: 4402 - RNA, 20 nt, Artificial Sequence
  synthetic oligonucleotide
cuagugagggacagaaccag

SEQ ID NO: 4403 - RNA, 14 nt, Artificial Sequence
  synthetic oligonucleotide
cugucccucacuag

SEQ ID NO: 4404 - RNA, 23 nt, Artificial Sequence
  synthetic oligonucleotide
gcagcagagaauaggacuacguc

SEQ ID NO: 4405 - RNA, 20 nt, Artificial Sequence
  synthetic oligonucleotide
gcagcagagaauaggacuac

SEQ ID NO: 4406 - RNA, 14 nt, Artificial Sequence
  synthetic oligonucleotide
cuauucucugcugc

SEQ ID NO: 4407 - RNA, 20 nt, Artificial Sequence
  synthetic oligonucleotide
agagucuugugaugucuugc

SEQ ID NO: 4408 - RNA, 20 nt, Artificial Sequence
  synthetic oligonucleotide
agagucuugugaugucuugc

SEQ ID NO: 4409 - RNA, 14 nt, Artificial Sequence
  synthetic oligonucleotide
caucacaagacucu

SEQ ID NO: 4410 - RNA, 22 nt, Artificial Sequence
  synthetic oligonucleotide
uauugcacuugucccggccugu

SEQ ID NO: 4411 - RNA, 20 nt, Artificial Sequence
  synthetic oligonucleotide
uauugcacuugucccggccu

SEQ ID NO: 4412 - RNA, 14 nt, Artificial Sequence
  synthetic oligonucleotide
ggacaagugcaaua

SEQ ID NO: 4413 - RNA, 23 nt, Artificial Sequence
  synthetic oligonucleotide
agguugggaucgguugcaaugcu

SEQ ID NO: 4414 - RNA, 20 nt, Artificial Sequence
  synthetic oligonucleotide
agguugggaucgguugcaau

SEQ ID NO: 4415 - RNA, 14 nt, Artificial Sequence
  synthetic oligonucleotide
accgaucccaaccu

SEQ ID NO: 4416 - RNA, 22 nt, Artificial Sequence
  synthetic oligonucleotide
ggguggggauuuguugcauuac

SEQ ID NO: 4417 - RNA, 20 nt, Artificial Sequence
  synthetic oligonucleotide
ggguggggauuuguugcauu

SEQ ID NO: 4418 - RNA, 14 nt, Artificial Sequence
  synthetic oligonucleotide
acaaauccccaccc

SEQ ID NO: 4419 - RNA, 22 nt, Artificial Sequence
  synthetic oligonucleotide
uauugcacucgucccggccucc

SEQ ID NO: 4420 - RNA, 20 nt, Artificial Sequence
  synthetic oligonucleotide
uauugcacucgucccggccu

SEQ ID NO: 4421 - RNA, 14 nt, Artificial Sequence
  synthetic oligonucleotide
ggacgagugcaaua

SEQ ID NO: 4422 - RNA, 22 nt, Artificial Sequence
  synthetic oligonucleotide
agggacgggacgcggugcagug

SEQ ID NO: 4423 - RNA, 20 nt, Artificial Sequence
  synthetic oligonucleotide
agggacgggacgcggugcag

SEQ ID NO: 4424 - RNA, 14 nt, Artificial Sequence
  synthetic oligonucleotide
cgcgucccgucccu

SEQ ID NO: 4425 - RNA, 23 nt, Artificial Sequence
  synthetic oligonucleotide
caaagugcuguucgugcagguag

SEQ ID NO: 4426 - RNA, 20 nt, Artificial Sequence
  synthetic oligonucleotide
caaagugcuguucgugcagg

SEQ ID NO: 4427 - RNA, 14 nt, Artificial Sequence
  synthetic oligonucleotide
cgaacagcacuuug

SEQ ID NO: 4428 - RNA, 22 nt, Artificial Sequence
  synthetic oligonucleotide
acugcugagcuagcacuucccg

SEQ ID NO: 4429 - RNA, 20 nt, Artificial Sequence
  synthetic oligonucleotide
acugcugagcuagcacuucc

SEQ ID NO: 4430 - RNA, 14 nt, Artificial Sequence
  synthetic oligonucleotide
gcuagcucagcagu

SEQ ID NO: 4431 - RNA, 22 nt, Artificial Sequence
  synthetic oligonucleotide
ugugcgcagggagaccucuccc

SEQ ID NO: 4432 - RNA, 20 nt, Artificial Sequence
  synthetic oligonucleotide
ugugcgcagggagaccucuc

SEQ ID NO: 4433 - RNA, 14 nt, Artificial Sequence
  synthetic oligonucleotide
ucucccugcgcaca

SEQ ID NO: 4434 - RNA, 22 nt, Artificial Sequence
  synthetic oligonucleotide
ugucuacuacuggagacacugg

SEQ ID NO: 4435 - RNA, 20 nt, Artificial Sequence
  synthetic oligonucleotide
ugucuacuacuggagacacu

SEQ ID NO: 4436 - RNA, 14 nt, Artificial Sequence
  synthetic oligonucleotide
uccaguaguagaca

SEQ ID NO: 4437 - RNA, 23 nt, Artificial Sequence
  synthetic oligonucleotide
ccaguuaccgcuuccgcuaccgc

SEQ ID NO: 4438 - RNA, 20 nt, Artificial Sequence
  synthetic oligonucleotide
ccaguuaccgcuuccgcuac

SEQ ID NO: 4439 - RNA, 14 nt, Artificial Sequence
  synthetic oligonucleotide
gaagcgguaacugg

SEQ ID NO: 4440 - RNA, 22 nt, Artificial Sequence
  synthetic oligonucleotide
acaguagagggaggaaucgcag

SEQ ID NO: 4441 - RNA, 20 nt, Artificial Sequence
  synthetic oligonucleotide
acaguagagggaggaaucgc

SEQ ID NO: 4442 - RNA, 14 nt, Artificial Sequence
  synthetic oligonucleotide
ccucccucuacugu

SEQ ID NO: 4443 - RNA, 22 nt, Artificial Sequence
  synthetic oligonucleotide
auccgcgcucugacucucugcc

SEQ ID NO: 4444 - RNA, 20 nt, Artificial Sequence
  synthetic oligonucleotide
auccgcgcucugacucucug

SEQ ID NO: 4445 - RNA, 14 nt, Artificial Sequence
  synthetic oligonucleotide
gucagagcgcggau

SEQ ID NO: 4446 - RNA, 22 nt, Artificial Sequence
  synthetic oligonucleotide
ugcccuuaaaggugaacccagu

SEQ ID NO: 4447 - RNA, 20 nt, Artificial Sequence
  synthetic oligonucleotide
ugcccuuaaaggugaaccca

SEQ ID NO: 4448 - RNA, 14 nt, Artificial Sequence
  synthetic oligonucleotide
caccuuuaagggca

SEQ ID NO: 4449 - RNA, 24 nt, Artificial Sequence
  synthetic oligonucleotide
uggggagcugaggcucugggggug

SEQ ID NO: 4450 - RNA, 20 nt, Artificial Sequence
  synthetic oligonucleotide
uggggagcugaggcucuggg

SEQ ID NO: 4451 - RNA, 14 nt, Artificial Sequence
  synthetic oligonucleotide
gccucagcucccca

SEQ ID NO: 4452 - RNA, 21 nt, Artificial Sequence
  synthetic oligonucleotide
aaggcagggcccccgcucccc

SEQ ID NO: 4453 - RNA, 20 nt, Artificial Sequence
  synthetic oligonucleotide
aaggcagggcccccgcuccc

SEQ ID NO: 4454 - RNA, 14 nt, Artificial Sequence
  synthetic oligonucleotide
gggggcccugccuu

SEQ ID NO: 4455 - RNA, 23 nt, Artificial Sequence
  synthetic oligonucleotide
cacccggcugugugcacaugugc

SEQ ID NO: 4456 - RNA, 20 nt, Artificial Sequence
  synthetic oligonucleotide
cacccggcugugugcacaug

SEQ ID NO: 4457 - RNA, 14 nt, Artificial Sequence
  synthetic oligonucleotide
cacacagccgggug

SEQ ID NO: 4458 - RNA, 22 nt, Artificial Sequence
  synthetic oligonucleotide
ucuucucuguuuuggccaugug

SEQ ID NO: 4459 - RNA, 20 nt, Artificial Sequence
  synthetic oligonucleotide
ucuucucuguuuuggccaug

SEQ ID NO: 4460 - RNA, 14 nt, Artificial Sequence
  synthetic oligonucleotide
caaaacagagaaga

SEQ ID NO: 4461 - RNA, 21 nt, Artificial Sequence
  synthetic oligonucleotide
cugacuguugccguccuccag

SEQ ID NO: 4462 - RNA, 20 nt, Artificial Sequence
  synthetic oligonucleotide
cugacuguugccguccucca

SEQ ID NO: 4463 - RNA, 14 nt, Artificial Sequence
  synthetic oligonucleotide
acggcaacagucag

SEQ ID NO: 4464 - RNA, 22 nt, Artificial Sequence
  synthetic oligonucleotide
aaauuauuguacaucggaugag

SEQ ID NO: 4465 - RNA, 20 nt, Artificial Sequence
  synthetic oligonucleotide
aaauuauuguacaucggaug

SEQ ID NO: 4466 - RNA, 14 nt, Artificial Sequence
  synthetic oligonucleotide
auguacaauaauuu

SEQ ID NO: 4467 - RNA, 22 nt, Artificial Sequence
  synthetic oligonucleotide
uucaacggguauuuauugagca

SEQ ID NO: 4468 - RNA, 20 nt, Artificial Sequence
  synthetic oligonucleotide
uucaacggguauuuauugag

SEQ ID NO: 4469 - RNA, 14 nt, Artificial Sequence
  synthetic oligonucleotide
aaauacccguugaa

SEQ ID NO: 4470 - RNA, 23 nt, Artificial Sequence
  synthetic oligonucleotide
uuuggcacuagcacauuuuugcu

SEQ ID NO: 4471 - RNA, 20 nt, Artificial Sequence
  synthetic oligonucleotide
uuuggcacuagcacauuuuu

SEQ ID NO: 4472 - RNA, 14 nt, Artificial Sequence
  synthetic oligonucleotide
gugcuagugccaaa

SEQ ID NO: 4473 - RNA, 22 nt, Artificial Sequence
  synthetic oligonucleotide
aaucaugugcagugccaauaug

SEQ ID NO: 4474 - RNA, 20 nt, Artificial Sequence
  synthetic oligonucleotide
aaucaugugcagugccaaua

SEQ ID NO: 4475 - RNA, 14 nt, Artificial Sequence
  synthetic oligonucleotide
cacugcacaugauu

SEQ ID NO: 4476 - RNA, 22 nt, Artificial Sequence
  synthetic oligonucleotide
ugagguaguaaguuguauuguu

SEQ ID NO: 4477 - RNA, 20 nt, Artificial Sequence
  synthetic oligonucleotide
ugagguaguaaguuguauug

SEQ ID NO: 4478 - RNA, 14 nt, Artificial Sequence
  synthetic oligonucleotide
aacuuacuaccuca

SEQ ID NO: 4479 - RNA, 22 nt, Artificial Sequence
  synthetic oligonucleotide
aacccguagauccgaucuugug

SEQ ID NO: 4480 - RNA, 20 nt, Artificial Sequence
  synthetic oligonucleotide
aacccguagauccgaucuug

SEQ ID NO: 4481 - RNA, 14 nt, Artificial Sequence
  synthetic oligonucleotide
cggaucuacggguu

SEQ ID NO: 4482 - RNA, 22 nt, Artificial Sequence
  synthetic oligonucleotide
caagcucgcuucuaugggucug

SEQ ID NO: 4483 - RNA, 20 nt, Artificial Sequence
  synthetic oligonucleotide
caagcucgcuucuauggguc

SEQ ID NO: 4484 - RNA, 14 nt, Artificial Sequence
  synthetic oligonucleotide
uagaagcgagcuug

SEQ ID NO: 4485 - RNA, 22 nt, Artificial Sequence
  synthetic oligonucleotide
cacccguagaaccgaccuugcg

SEQ ID NO: 4486 - RNA, 20 nt, Artificial Sequence
  synthetic oligonucleotide
cacccguagaaccgaccuug

SEQ ID NO: 4487 - RNA, 14 nt, Artificial Sequence
  synthetic oligonucleotide
cgguucuacgggug

SEQ ID NO: 4488 - RNA, 22 nt, Artificial Sequence
  synthetic oligonucleotide
caagcucgugucuguggguccg

SEQ ID NO: 4489 - RNA, 20 nt, Artificial Sequence
  synthetic oligonucleotide
caagcucgugucuguggguc

SEQ ID NO: 4490 - RNA, 14 nt, Artificial Sequence
  synthetic oligonucleotide
cagacacgagcuug

What is claimed is:

1. An isolated nucleic acid molecule comprising
a guide strand of 18-23 nucleotides in length that has complementarity to a miRNA sequence, and
a passenger strand of 8-16 nucleotides in length,
wherein the guide strand and the passenger strand form the nucleic acid molecule such that the nucleic acid molecule has a double stranded region of 10-15 nucleotides in length and a single stranded region, wherein the single stranded region is at the 3' end of the guide strand and is 2-13 nucleotides in length and comprises at least two phosphorothioate modifications, wherein at least 50% of the pyrimidines in the nucleic acid molecule are modified, and wherein the isolated nucleic acid molecule modulates miRNA-mediated gene expression in a mammalian cell.

2. The nucleic acid molecule of claim 1, wherein the nucleotide in position one of the guide strand has a 2'-O-methyl modification.

3. The nucleic acid molecule of claim 2, wherein at least 60%, at least 80%, at least 90% or wherein 100% of the pyrimidines in the nucleic acid molecule are modified.

4. The nucleic acid molecule of claim 2, wherein modified pyrimidines are 2'fluoro or 2'O methyl modified.

5. The nucleic acid molecule of claim 2, wherein at least one U or C includes a hydrophobic modification.

6. The nucleic acid molecule of claim 5, wherein the hydrophobic modification is a methyl or ethyl hydrophobic base modification.

7. The nucleic acid molecule of claim 2, wherein the guide strand contains 6-8 phosphorothioate modifications.

8. The nucleic acid molecule of claim 2, wherein the guide strand includes 4-14 phosphate modifications.

9. The nucleic acid molecule of claim 2, wherein the single stranded region of the guide strand is 6 nucleotides long or 8 nucleotides long.

10. The nucleic acid molecule of claim 2, wherein the double stranded region is 13 nucleotides long.

11. The nucleic acid molecule of claim 2, wherein the double stranded nucleic acid molecule has one end that is blunt or includes a one nucleotide overhang.

12. The nucleic acid molecule of claim 2, wherein the passenger strand is linked at the 3' end to a sterol.

13. The nucleic acid molecule of claim 2, wherein the isolated double stranded nucleic acid molecule is an miRNA mimic and wherein the miRNA sequence to which the guide strand is complementary is a miRNA recognition element.

14. The nucleic acid molecule of claim 2, wherein the isolated double stranded nucleic acid molecule is an miRNA inhibitor and wherein the miRNA sequence to which the guide strand is complementary is an antisense strand of a mature miRNA.

15. The nucleic acid molecule of claim 14, wherein the guide strand is at least 50% chemically modified.

16. The nucleic acid molecule of claim 14, wherein the mature miRNA is miR 17-92.

17. A method for modulating miRNA-mediated gene expression in a mammalian cell, comprising contacting the mammalian cell with an isolated double stranded nucleic acid molecule of claim 1 in an effective amount to modulate miRNA-mediated gene expression.

18. The method of claim 17, wherein the mammalian cell is contacted with the isolated nucleic acid in vivo or ex vivo.

19. A method for modulating miRNA-mediated gene expression in a stem cell, comprising contacting the stem cell with an isolated double stranded nucleic acid molecule of claim 1 in an effective amount to modulate miRNA-mediated gene expression in the stem cell.

20. The nucleic acid molecule of claim 2, wherein the 2'-O-methyl modification is a 5P-2'O-methyl U modification.

21. The nucleic acid molecule of claim 2, wherein a plurality of U's and/or C's include a hydrophobic modification.

22. The nucleic acid molecule of claim 2, wherein the 3' terminal 10 nucleotides of the guide strand include at least eight phosphorothioate modifications.

23. The nucleic acid molecule of claim 12, wherein the sterol is cholesterol.

24. The nucleic acid molecule of claim 13, wherein the miRNA mimic is a mimic of a miRNA selected from the group consisting of miR21, miR 139, miR 7, miR29, miR 122, miR 302-367 cluster, miR 221, miR-96, miR 126, miR 225 and miR 206.

* * * * *